United States Patent 7,745,391 (HUMAN THROMBOSPONDIN POLYPEPTIDE) - sequence listing, part 196

SEQ ID NO: 464030 - DNA, 5683 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactatagtaaaaaaataagttgtcctgggtgaaaaaataaaaaatctagcggtaaaagagaacgctgcaagaggg

SEQ ID NO: 464031 - DNA, 4144 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcagagtaaaaaaaaacatttgcggccg

SEQ ID NO: 464032 - DNA, 2812 bp, Homo sapiens
ccatgcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccattgctgagcatgaaattcgtaatatctcctgtgctgcccaggacccagaagacctctcaacatttgcctatatcacaaaagatttgaagtctaatcaccactactgtcatgtgtttactgcctttgatgtgattttagcctatgaaatcatcctaatcctggcacaggcattcgaagtcgcttaccagctagcactacaagcaagaataagggggacactcctccacagcttccagaaagctttgaaaacaaccgcttctaaccctatc

SEQ ID NO: 464033 - DNA, 610 bp, Homo sapiens
cctgcttctgctcacaccttgcacatgaattcagagggcagtatggccaagttgactatttccacttgtgttccagctgccatgccacaccacctcacctctgcccatccgcccccagatcttcggtggtggtataaaaatcagatagctcagcacttcgctccaaaggagctgaaggagagaggattccactgcgtgtatgttttctctttcacgtctcacttttgttctctgccatcaggaaatgcagtagacatttgtcaccagcagctctttggagacttcaatgttccttcctcccaggatccgaaaggggacttcagacacggagaatctaagacaccaggagctcagaagaatggagtctcaagacatcaggcaaataccgaagagatcagagccaagttctaaagggcagccatttcccaaatgtcaaccaagagcgaagccaagagaattatgatttcctggctatacaatcacaggaaaagcttgatcaaagctggagtgcaagttaaaaagtgtaaggtactcaagtgctagggtctgtgtccaagcccaatcaattgatcattagttgtttttaacttcaacgtttcttttgcaacag

SEQ ID NO: 464034 - DNA, 345 bp, Homo sapiens
cattatgagttgtcatagtataagaggtaggtttggaggattgatagtgttcttaacttcagggagaatctaagacaccaggagctcagaagaatggagtctcaagacatcaggcaaataccgaagagatcagagccaagttctaaagggcagccatttcccaaatgtcaaccaagagcgaagccaagagaattatgatttcctggctatacaatcacaggaaaagcttgatcaaagctggagtgcaagttaaaaagtgtaaggtactcaagtgctagggtctgtgtccaagcccaatcaattgatcattagttgtttttaacttcaacgtttcttttgcaacag

SEQ ID NO: 464035 - DNA, 2227 bp, Homo sapiens
ccggcgggccgcgccgcgagccagtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464036 - DNA, 2419 bp, Homo sapiens
ccggcgggccgcgccgcgagccagtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtggagcagcctgtggaggagagctcaggcaccttccaagcgaggcctgtgacgggtggaggggcaaagagtggtgctccctgctgttgagagcactcaggctctgcaggggcatctcccaaccttccacctctttccttctgagagatgccaagatgtcagcctgagcacctggagtgaccagccctgagctcc

SEQ ID NO: 464037 - DNA, 2445 bp, Homo sapiens
gctggtctggtcggaagttgttggatgccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtaaggaaggcacctcccagtccttgccaaactgcatatccctggggtgagcctgcagcgctgtccttgcctctggacagaggaagagccaggatccccagtcctacccctgcgtccctgcctccctgccttccccgctggtactctgctgctcaaagcagcttttcagccttccccatctgttctgcccgccccgtgttgggaaaactgcttgggccagcagtccatggccctaggagagagaatcggctggccgctgctggagccgcagagcagctgccaaactgcagtccttcgagtccctgcgagggcggccggagctgcaaggaccccgccgccagggggcgcccgccggccgcgccctcacgaggtgcccttgcaggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464038 - DNA, 2063 bp, Homo sapiens
gctggtctggtcggaagttgttggatgccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464039 - DNA, 2223 bp, Homo sapiens
  misc_feature (23)..(23): n is a, c, g, or t
  misc_feature (26)..(26): n is a, c, g, or t
  misc_feature (32)..(32): n is a, c, g, or t
  misc_feature (53)..(53): n is a, c, g, or t
aagccctaattatggctgacacntanttgaanacccagcgtgttgtttttaanaacacagctgtcgtcggattcggatgacagcgcgcgctaggttcgggcggcgcgggactctcggcatgcagcctgtcaaggacagagcagtcaggaggtgagcctaaccactgcatccccaactgctgcagcagacggaatcagaacccatctcgctggaggagactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464040 - DNA, 2016 bp, Homo sapiens
ccggcgggccgcgccgcgagccagtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcacccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464041 - DNA, 2225 bp, Homo sapiens
tggggcggagaggggcccggggtgggtttcggggcgcgggccaaggggagcgagcccggcccgcggcttcagcgctccccggccggcgcggaaggggtgaggctgggcgtccgcgcgagcttcgagaaaaggaaagacaaaaagttttggcggccaggggcttcccgggcgtttatctcgaaactcttttcgccgtctcttgcctgaaatatgccgagcccggtacggctctgtcgtcccacttcctgctgcggtttccacctcgagctgggctcagctaatttgttgtgacagctgtcggcagccgcccctccgccccgtgacatcccgcaggtttcagaaccgcggcgccgccgggcacagactccgggtccagagcgcgcggccctttcctctgcggccgccgtttcctgaaaggggctgcgcgggtgtgaagaacttgctcaatgcgctttgtaggatccactgttcctctttcggccgcgggctgcgccgatggtccggggagcccggcttctcgccccctgccccttccttctcttcccttctctcttttcctctcctgtctctccgcccacccgccgcagccccacaggagaggggtcgcttccctggttgctctcctctcctgtcccttgtgtgtccccttgtcttccctcggtctgcagaagggacggggtggcggctggggagcgtcaggggaagagggcaagagcgtgggctacgagcttgcaggcgatgcccggcttcgcgctcggcgggagctgcgggccaacccgggcccgcgctccgtccctccgcggtgtctaggggtcgcccgggctggggtcgcgtcaccctccgcccagcgccggcgtggtggggcttgcgcggtgcaggacccccgagggcccagggggtcccaaggcgctgcgggtccagtgtccctttgtttgcagagtcttgggccagtaaggagtgctccgcgggccccaggggaggacaacaggtgcctcttgccccacccgggctcctctggtgggagcccacacgcacggtggcgtcactgcgcctacaggcaacgctagagcacaggaggggtgggaggtcggggctcgagggcttcaccccgcagcagagctcagagcccaatccaggccttagggacccgcctggggcctagaacttggtgtggcagaggtagaaagggcctccgataatctgcttctacagttgagagacgtcaactggcacctctgagcctctgccccgtaggtgaaatgggaacacacgaaaccatctgaggagctctcactgtccgtcaccaccaaatgtggcccagactccgtggggagggacagtcccatcctggaactggggcttttaggacatcccagagcccgcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtaaggaaggcacctcccagtccttgccaaactgcatatccctggggtgagcctgcagcgctgtccttgcctctggacagaggaagagccaggatccccagtcctacccctgcgtccctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464042 - DNA, 395 bp, Homo sapiens
ttaataatagagacggggtctcactacgttgcccagacaggtcttgaactcctgacctcaggtcatcgcctgcctgggcctcccaaagtgctgggatcacaggagtgagcccctgcactggcgccctctggcaactccaattgggagtagggagagtgctcctgttcctccctgcttgcatctcatatgctctctccccaccccttcctccttactccttccctctctccttgcagcagcccctgtcaaagggaacaggaagcagtccacggagggtgacgccctagacccacctgcatcccccaaacctgctggcaagcagaacggaatccagaaccccatctcgctggaggtgagttgactccctctgctgactccctgggcactcttccctg

SEQ ID NO: 464043 - DNA, 491 bp, Homo sapiens
ctccacagatggttgtgcaagtggactctgaactccagcctgcgcccacccaccaggcacctgaggctgtgtccactcagaggacagggcacctttggaaaattctgtacagaggactgcaggggctggcgggggacctgggcaggcctgaaagtgccacctcttgctcctcaggtcaggatgtggggctgaggcagtcctgaggcaagactttctctcattccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagg

SEQ ID NO: 464044 - DNA, 2088 bp, Homo sapiens
ccggcgggccgcgccgcgagccagtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464045 - DNA, 3887 bp, Homo sapiens
tggggcggagaggggcccggggtgggtttcggggcgcgggccaaggggagcgagcccggcccgcggcttcagcgctccccggccggcgcggaaggggtgaggctgggcgtccgcgcgagcttcgagaaaaggaaagacaaaaagttttggcggccaggggcttcccgggcgtttatctcgaaactcttttcgccgtctcttgcctgaaatatgccgagcccggtacggctctgtcgtcccacttcctgctgcggtttccacctcgagctgggctcagctaatttgttgtgacagctgtcggcagccgcccctccgccccgtgacatcccgcaggtttcagaaccgcggcgccgccgggcacagactccgggtccagagcgcgcggccctttcctctgcggccgccgtttcctgaaaggggctgcgcgggtgtgaagaacttgctcaatgcgctttgtaggatccactgttcctctttcggccgcgggctgcgccgatggtccggggagcccggcttctcgccccctgccccttccttctcttcccttctctcttttcctctcctgtctctccgcccacccgccgcagccccacaggagaggggtcgcttccctggttgctctcctctcctgtcccttgtgtgtccccttgtcttccctcggtctgcagaagggacggggtggcggctggggagcgtcaggggaagagggcaagagcgtgggctacgagcttgcaggcgatgcccggcttcgcgctcggcgggagctgcgggccaacccgggcccgcgctccgtccctccgcggtgtctaggggtcgcccgggctggggtcgcgtcaccctccgcccagcgccggcgtggtggggcttgcgcggtgcaggacccccgagggcccagggggtcccaaggcgctgcgggtccagtgtccctttgtttgcagagtcttgggccagtaaggagtgctccgcgggccccaggggaggacaacaggtgcctcttgccccacccgggctcctctggtgggagcccacacgcacggtggcgtcactgcgcctacaggcaacgctagagcacaggaggggtgggaggtcggggctcgagggcttcaccccgcagcagagctcagagcccaatccaggccttagggacccgcctggggcctagaacttggtgtggcagaggtagaaagggcctccgataatctgcttctacagttgagagacgtcaactggcacctctgagcctctgccccgtaggtgaaatgggaacacacgaaaccatctgaggagctctcactgtccgtcaccaccaaatgtggcccagactccgtggggagggacagtcccatcctggaactggggcttttaggacatcccagagcccgcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtaaggaaggcacctcccagtccttgccaaactgcatatccctggggtgagcctgcagcgctgtccttgcctctggacagaggaagagccaggatccccagtcctacccctgcgtccctgcctccctgccttccccgctggtactctgctgctcaaagcagcttttcagccttccccatctgttctgcccgccccgtgttgggaaaactgcttgggccagcagtccatggccctaggagagagaatcggctggccgctgctggagccgcagagcagctgccaaactgcagtccttcgagtccctgcgagggcggccggagctgcaaggaccccgccgccagggggcgcccgccggccgcgccctcacgaggtgcccttgcaggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464046 - DNA, 2609 bp, Homo sapiens
ccggcgggccgcgccgcgagccagtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtaaggaaggcacctcccagtccttgccaaactgcatatccctggggtgagcctgcagcgctgtccttgcctctggacagaggaagagccaggatccccagtcctacccctgcgtccctgcctccctgccttccccgctggtactctgctgctcaaagcagcttttcagccttccccatctgttctgcccgccccgtgttgggaaaactgcttgggccagcagtccatggccctaggagagagaatcggctggccgctgctggagccgcagagcagctgccaaactgcagtccttcgagtccctgcgagggcggccggagctgcaaggaccccgccgccagggggcgcccgccggccgcgccctcacgaggtgcccttgcaggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgtagccctgaggtgtgtgtg

SEQ ID NO: 464047 - DNA, 1528 bp, Homo sapiens
ccggcgggccgcgccgcgagccagtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcactcccactgccccagagcggagctcgaagcacccaggttgcccacggaaaatccaataaaaagacaccagtgtgaatccacgtagccctgaggtgtgtgtg

SEQ ID NO: 464048 - DNA, 2887 bp, Homo sapiens
gtttgttcgcggggcggggcgaggcaggatatcacgtgaccctgcgagtggctcagatccgaactggccgcctttctccccttcccccaccccaggtacgcgcggccacgccctctccagcgccattgttatttaggctggggggtctctgggctcctggcggccggggtcgggggaaattcctttactattctttgggggaagatcaaaataacttgtgtttttttgtttgttttttgtgcccagcccttgtgggagcggcgaggttccctaaccccaatcctggcatctcggctaaggggctttattagagggaacttgtctagcacgagagaacctcctcccacaaaatggccctggggttgggtaggtcggtaaaggctgctaaatcgcatttaccccaaggaggaagaaaggaccctccctattccaaaagccgcctttaggcgcctgacaataagaagtcgcttctgttaagagtttacgtggttttggtagggggcggggaaggccaaatcctaaaatagtgtctgccttttattcagaatttcccttcgctctttactgtactaaacgctttacaggaattatcccattgaattcttacactcgagtctttcattctgaaactaacttgttaatcgtctgttccctacattcgaattttagctccccttggtggtcctcaccgctgtaaatctatgtctagcccagtgcctggcagccaagtcttcagttctagttgtagatgttttataggtaaagaatttgagacacaagagattgagtaacttgtccgagatcacggctgtgtggtgcagaagctggattctgatctgcggcgggttggctccagaacgtgagttgttgaacacaattctggtgaaagacaacccaagatgttcgttaccctccacgggggacctactgaagatgtgctgctttagttgaatcccacaccacattcagtctctggcgaggcttcagccaccaccccctccccagcctccgccaaaaaaattgttttgataatttagtggaagaatattaaattgattttccttcagaataaaggctacttttcagtttgcagtttacaatgtatagctctgttgtaagggcgagaatattgtctttgaagtgtaccgggttaaggtatcttatgggcgtacagattcagaagcttctccaagactttttcaatggaaaagaactgaataagagcatcagccctaatgaagctgttgcttatggtgcagctgtccaagcagccattctgtctggcaacaaatctgaaaatgctcaagatttgttgcttttcagacagaccttcactacctactctgacaggcagcctgatgtgcttattcaggtttatgaaggtgagcatgtcatgaccaaggatagcaacctgcttggcaagtttcaactcacaggcatacctttggcactccaaggtgttcctcacattgaagtcacatttgatattgatgccaatggcatcttcagtgtctctgctgtgcacaagaagttggccttgagtttggaatgtgtgaaaatagacattccaggtgaagggaacctaggtggctccctctccagcaaaggcatggaggcagatgagcgctcttggagaaatgagaatggggagaaatcgtccatgaacatggagattggacatccccacgaaggaaaggatgatttaggagacaagagggtcatcatgggaacaaaatttcccatggagttggggatcagagtaggattaggaaaagaagattcccgatgcggggagagccctgtggttagtaataagtgtgagggaaggatggcaccaccagaaacaaaatttccattgagcaaggggcttgaaatgggattagaaagacagaatatttctaggactgtcatgcagaggggtagtttaggagtcgacagtgtctcagcttcacagggaacaaaaccttctctgttgccaggaagaatggggttagaaaatgagagtcttcttgcaggatatacccatgaacggataatacagcctcctttgggcagggtgtgtggaagttcacaggctgcagggagcaggagagctcctttggctagtggccctgaaggggtagaggaattagtgggaaagcctgctttcgttatggaaccaagacaggaaatggaaaaagagtctacctgtgttttaatgaaacccaacacagagattaagcttcctgtggaggtggacattggactaacccaagccgaggggccagatgagactaagaatacagagccccaaatgggcttggtgatagaacctccccaatgccagtttgcccaacaacatgaacagagaaaggaggctggaaacattgaatcaggagtggaacctccagatcgcatcagacccatatactctgggaagttttttgatcggaccccttgctggccaagttctgtgagttatttgttctttcagcaaagacttgtggtagccattgtgccagaatactctgctaaagatgtggtgaatccaccaaaatcctatgaagaagtatttaaagaaggaaatgaaggacatgatttgtatgttgtttctcacaatgattattatgcaggtaagtgtcctccgatgcaaaatgggcctgaggatatgggactctcggatttgtgaagaggaataaaggaaattggtacataaagttaaatgcctgccatgtaatagatggtgttgatgcttgtagatgttccttggtgtctggcattgaacagttaggtatttattgtagtcctcactgtctgtgcttatttgtacccattcatcttggaaatgctttccagatatttgaaaggacttgtgtgttgtgatctaagctgtatctgctttaggggg

SEQ ID NO: 464049 - DNA, 2223 bp, Homo sapiens
gtttgttcgcggggcggggcgaggcaggatatcacgtgaccctgcgagtggctcagatccgaactggccgcctttctccccttcccccaccccaggtaaagaatttgagacacaagagattgagtaacttgtccgagatcacggctgtgtggtgcagaagctggattctgatctgcggcgggttggctccagaacgtgagttgttgaacacaattctggtgaaagacaacccaagatgttcgttaccctccacgggggacctactgaagatgtgctgctttagttgaatcccacaccacattcagtctctggcgaggcttcagccaccaccccctccccagcctccgccaaaaaaattgttttgataatttagtggaagaatattaaattgattttccttcagaataaaggctacttttcagtttgcagtttacaatgtatagctctgttgtaagggcgagaatattgtctttgaagtgtaccgggttaaggtatcttatgggcgtacagattcagaagcttctccaagactttttcaatggaaaagaactgaataagagcatcagccctaatgaagctgttgcttatggtgcagctgtccaagcagccattctgtctggcaacaaatctgaaaatgctcaagatttgttgcttttcagacagaccttcactacctactctgacaggcagcctgatgtgcttattcaggtttatgaaggtgagcatgtcatgaccaaggatagcaacctgcttggcaagtttcaactcacaggcatacctttggcactccaaggtgttcctcacattgaagtcacatttgatattgatgccaatggcatcttcagtgtctctgctgtgcacaagaagttggccttgagtttggaatgtgtgaaaatagacattccaggtgaagggaacctaggtggctccctctccagcaaaggcatggaggcagatgagcgctcttggagaaatgagaatggggagaaatcgtccatgaacatggagattggacatccccacgaaggaaaggatgatttaggagacaagagggtcatcatgggaacaaaatttcccatggagttggggatcagagtaggattaggaaaagaagattcccgatgcggggagagccctgtggttagtaataagtgtgagggaaggatggcaccaccagaaacaaaatttccattgagcaaggggcttgaaatgggattagaaagacagaatatttctaggactgtcatgcagaggggtagtttaggagtcgacagtgtctcagcttcacagggaacaaaaccttctctgttgccaggaagaatggggttagaaaatgagagtcttcttgcaggatatacccatgaacggataatacagcctcctttgggcagggtgtgtggaagttcacaggctgcagggagcaggagagctcctttggctagtggccctgaaggggtagaggaattagtgggaaagcctgctttcgttatggaaccaagacaggaaatggaaaaagagtctacctgtgttttaatgaaacccaacacagagattaagcttcctgtggaggtggacattggactaacccaagccgaggggccagatgagactaagaatacagagccccaaatgggcttggtgatagaacctccccaatgccagtttgcccaacaacatgaacagagaaaggaggctggaaacattgaatcaggagtggaacctccagatcgcatcagacccatatactctgggaagttttttgatcggaccccttgctggccaagttctgtgagttatttgttctttcagcaaagacttgtggtagccattgtgccagaatactctgctaaagatgtggtgaatccaccaaaatcctatgaagaagtatttaaagaaggaaatgaaggacatgatttgtatgttgtttctcacaatgattattatgcaggtaagtgtcctccgatgcaaaatgggcctgaggatatgggactctcggatttgtgaagaggaataaaggaaattggtacataaagttaaatgcctgccatgtaatagatggtgttgatgcttgtagatgttccttggtgtctggcattgaacagttaggtatttattgtagtcctcactgtctgtgcttatttgtacccattcatcttggaaatgctttccagatatttgaaaggacttgtgtgttgtgatctaagctgtatctgctttaggggg

SEQ ID NO: 464050 - DNA, 2116 bp, Homo sapiens
cacaggaaccaccaaatccacagcctgtatgaaagctgcttcttccaacctcagcagtgtcaaaagactggacaccagctggatttgaggtcccatcagcttttggggacctctccagcccaccggcatcaacactattattattttcattttaccataatggaaatggaagtgtagaaaaaacaagaaaattgtgtacctaactctccatggtaacctctctcactttttattattcaattattcaataaatattgattgagcatttatatatgtgtgggactgcgggaggaaagagaggagcagcagtacagcagaggcactggcacatctgtatgccagagaaggaatgggtggacaaaaactgcccttatatttggagcctgggaaatagccatccagaggcccattcatttccagagcagaaaataaataaggaagatggacaactgagagctgagcatggcagcagctctacacccatcttgtttcaccctgagcagctccctgttggtatttgtttgactattacgacgttgactaaaccattcaatgaacaaaaagcaataactctgaagacccgaccaagtcctagtgtcctgctgaatgatgatgagcatactgcttgcaggctaaacctggaggagcaaggccagagtcactgggacctggaatcaaagctggggcagcttctgctttttcctcctccttctaagcttccgtaagcctctcttcacttgtgccctccctcagctgtccttcaggatggtattttctgggcaccagtctcatactggctgccacttcatgtgtacaggaattagagtaaaagtaaaagagaaagcaaagaggatgaaaagggagcttctttattttcctagtttcttgtggtggaatatcagattacagatttgagacttttcttgagttctaatttaagcatttaatgctgtatattttcatctcaacattgttctatctgatggctcatgttttgatatgttgtattttcattttcaagtagttccaagtacatgtatttgtgccttatttggagtatattgtttaatttccaggtgtttagcgattttgctattgacttcctgttatttatttctagtttgagtctgctatcattaaaatatatatttgaaatgtgtttaaaaatttaaaaaatgtgttaggtgttgttttatgatgcaggatatggaacaacttaatgtatgtcccaaaggcacttgaaatttttatgtattctggttttgagtggaatatactgtatatgtcagttagaatgtgttcgttgattgtgttgtccagtgctgtcagttcttgcatcattcatttcgaagttccaacttttcgtgtgtacatatttaagattgtaatgtattgttggtggcttgattctttatcatgatataatggtaatctttgtctagtaattttgcttgctataaagtccactttgccatgtgttaacaaagccactcttatttttaaaatagtttttattagtgtatgcttggtagtttttttccatcttttaacttttaatctagcttctttattgaattttaaattgtttcttgcgcattgcaaattgttgagtcatattgctttatgctctctgctaatctatgtcttgtgattggtgtatttagaatatttacatttaagataattattatgatgacacttgtctgcctctttaatatttgactattagtttttttttaattatactttaagttttagggtacatgtgcacaacgtgcaggtttgttacatgtatatacatgtcccatgttggtgtgctatacccattaactcgtcatttaacattagacttctattagttttgtttgctcattcggtagattttatttgaaatgtttattatcaaaatgtataaattttaaataataatgtcttgataagttccactgcaaggaaaatgtttccaaagtgcttttgtagtgtttgatactctcttttcacaaattttttatgtgaatatctattatattaccataatgtacatctttaaacacttactgtctgtcttcataattagttaaaatattttaaaacatcattcttctaaactgagtct

SEQ ID NO: 464051 - DNA, 4045 bp, Homo sapiens
  misc_feature (1)..(3): n is a, c, g, or t
  misc_feature (6)..(9): n is a, c, g, or t
nnnagnnnnagatggggctggggcaagagctaagtcatattttcctcttgtcagctgttggtggaggtttctatggtggcatttccttgggtgctctgagtatgaccagttatatctctgtggaaagggacttccacaacaaaagaagtctgggagatgctgtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacaaaaaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtgttactgaacttgtatgtataatttttgggtggctaagacaagtctcctacatcctcagttcctcctctgtaaggggtgggggatagcagagaaaccagtgagactggctgggaaggaggatggtgggaaagtgtcacgggttttctgccccagagtgtgtcagcccctgtacctcctgggtagggttccttcaggccaggtctctgtgaagatggggacctagggatacctctggctgcagctctaccccacctcctgcctgcattatcttgtgggcttgggactggctagtctcccaggtagtctcaaggcaggtttgtgttggccttggggtgggaacaatggtttctggccaggctgctctgccttggttggcctgtaggttctgggggttggggggtgaccttcagtccctggcttgggatggacagtccagctgggtaggctgatcatgactcagtgcccaggaaggggcagatgggttgtcctaggacactgctcggagtgtgggcggcaggagatgcagcagctgtgtttcaaggggcaaaggggcagaatcgagtgattggtcacagaacaactggtgcctcttctgggctcaactctgccatccctggctccttaccatgacccctgctcctctgctcaaagacccacagaggctggtccgatattgcagataagagctgattcccagggtgggggggttgttgaaggtccaacaactacttggagttaggacctgaatgtgcaccatgctaagtgccaggaaaggctgtccccagcacacacttcactccctaggcctagcagcaggggcccaggaaatgaccccgtcgttattctcttgacctcaggaacttttgcttaacatctaacctgaagccactgggtaatgagtggactcactgttctgaattcaagtaagggaatacttggtcttggcagagaacattaaggccagaaggacctctggcctcagctctgccctgcctcttttgggggatggggtagtatccgctgtttagcccagcagacccttgacccctggcactcctgccagatccctgttccttgatttggatgaggactgctcaggtcttttaagctggggttagagggtcgtagacaggagagtaggaaagaaggaacatcagacctacaggaatctgccttcccacattcctctgacttggaatgactctggcctggcttggagacagtgctggtctctagaaaatgctagaggaatctgcattttctcttgtcataaaggcactgccttaggcctagatctttgagctagtcttgggataagggctgttagctggaaaatcttgtggtgtgtctaggccagcctggcctctagaatactaccaccagtttggga

SEQ ID NO: 464052 - DNA, 1984 bp, Homo sapiens
gccctctttcctacgatggctgtacccaggaagccggccgcaggttccctaagccgaggcagcgctggctgtagtttctctgggctcctgggctggtgcacctgcccctgccttcagaacgggcccctgtgcatggctggcatctgtgattgggggaggaagccctcaagccccatgtcggtgaccctggggcagctcagtgtttcctgcctcagcagctctgcccacctccagtccgtcagcagattctcccttgctggtctggcctttcgctccagcagtggcaggcacagctgcccacgtatctactcctggtcagggcctgattggacacagtcaccaaagggctccccgagggagcttcgtgaaaaatgcctgattgtcacatggtcacagaacaacataagccataatgctatcgtaccatataccactcatttcatgtactaatttcctattttgtcgtatggaaaatatttgacaatgcctctaggggaacattcgagtgtgcactgggggtggtgctgaagtaaccacggttaataacttggtgtatagtgttcttccatgcaaataggaatctttaaagatatatagagatatctatacacatgtgactttttattgatacaaaatgagcacatataagcatatatgtcacagcaacttttgtaaaggtcaaagactggaaataccaaacacgtccctcaaaagggattcagtggaatagattatgatgcagacatttaatagaattattgtttggtcattaaaaaaaagaggcagctctctgtacagatatgagaactccttacaacacattgttaaataaaacattgtatgcacatcatcaacccacttaattttccatcacagcttcacagagaggcagatgccacacaggccacccacccagatgcagagccagattccctgcgtggactggacgggagtttcccagctggagttctctcggccaagctgcctgtgacatggggttggaggtgctccagagagtcatggccacccctggaggaagtgacttgtggctgactgctcaaggggaagtcctgtggcagtggagtcgtcagcattaattcaaataagatctctccctgcacacaatctgctttcgtgttcctgatggattgaatcaagagtgaatgagctcctacttcgcgaaagcaaaacaaactaaacgcatcaaccacgaccgcagagcccccatctctcccaggagggtgagcccatgttgtgttttcatttgtcagaaatctatcttaggaagccattcctgagatctgttctaatttaggccatttttaaaaaaaataatgcagttgattcttttcccgtgatctttcttttctccatgacttaaatttccccaggaactattcaaatgccgcatctggggttttgtttttgttttttgatgaagtcatgactttctttaaacagtaattattaaacaaaccaaagggaaaccttctgtgaggatgctgtttacaaatatcaccacttttacaatcagtaatggaggttgcaaagtgcaggattctgagttccaggtgaaatatgatcctgtggactttctgaattgggatcccgggaagtgttcctcatgggtgccctgttaatagcacctctgctgacactggagtgtgacagccaccgtttgaaggcacagcggcctcttcccctgggttagagatgtaccgtgactccccagtctctgttgaaggccacgtgttacacacattcttctcctggtgggttcctggaccccagtcagctctggccaggatcagattcccaggccttgctctctaaccaggctggcccatcctcgcctggagccactgcccagagacccagcatggcccgtggatgaaccccagggatgtaagccttattggactgagataggagagccaggagtaggaacagaggaggatgtgtccagagcctgctggaaagagcc

SEQ ID NO: 464053 - DNA, 1021 bp, Homo sapiens
caatttacctaacacccgcgaacctcagtttcctaacctgaagaagaggaaatgggatcaattatcattcaccagtgccacactgtccaagctggcttcacagaagcctcagttgagtcagtgccagccctactctcctccctggtacttaatggtctgtcaacagcagtgatgcagaagcaagggtgctggaatggagacaggagtcctagtgctgactgccactggctgtatgactctggggagtgtggaggctttaatgcaggaaggaacatggaacttctgggatctgagggaagaccagtggggctggttagtgaggtggacatggacaggaaacagctggagaggcagggggcagaagtgactcagaaggtggattttcctccacagatgtctctgaccatggattgggacatgaatgggagcagagctccattccagagtccccagagaggaggcacttttgctcgagcttcactcagctgtgtcctctggatgctgggatatgagggtggcatgtggtacttcagaggttacaatgatgatcaagaactgatacccctcttcactgaaggcttatgtacatatatatccaaggcaaagcaaattgcaagaaacacagaaatggaaaaaccaaatgccgcaggaagaagataggaattccagcctgggaactctgagaagactggttgaaggaagtggctttcagtctaggtcttgggggagatgaaatttcatcctgcagacatgaggacagggccagaggaggaaaatgccatgtggagacagacacacagggagaagaactccatgtgacgcagaggcagagcgtggagagatgcaggcggaaggagtgccaaggattgctggccaccaccagaggctgggaagatgcaaggaaggattctacccagagtctcagacagagcatgtccctgtggaaaccttgatttcagacttctggcccccagaactgtgagagaataaatttctgttgtttaagccatccagtgtgtgg

SEQ ID NO: 464054 - DNA, 1360 bp, Homo sapiens
acctagttaacacctactcatcatcaagcatcacttccccagggatgcctcgctgacctccctgactgatgtcaatctcatggcatctgccttgcatagtactgttcacaggaaggactgacacaaaacagaagatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatggggggctggaaatggtctccattttgattgtgaggtggtggctacaagattgcatgcatttgtcaaactcatagaactgcacactgaaaagagtgaattgtactgtatgtcaattatacctaaataaatctgacttaacaaaaaaataaaacccagtattcttgtaatctctgaacacaa

SEQ ID NO: 464055 - DNA, 6551 bp, Homo sapiens
gttaccgccacgatgacagctctttacgccttccactccgtgctgggttcaaaggaaatcctcttcgcgcatctttctcgtgttctggccctgcggtactcttggagcagttgtaagttcacaacaaaactgagtggaaggtatagagatttcccatgtatcgcctacccctacagagccaaaatctctcatcagagtggccatgtgggccatgaggtccacgaccttgttgctgtagccaaattcatcgctataccaagaaatgatcttgacaaagtggttgttgagggcaatgccagccctaacattgaaggtggaagagtgcgtgttgctgttgaagttggaggagacagcctggtgctcagtgtagcccaggatgcccttgagggggccctccgatgtctgcttcaccaccttcttgatgtcatcatatttggcaggtttttccagatggcaggtcaggttaatgaccgacaccttggcagtggtgacacagaaggccatgccacaaatgaagcttggaaagattttcatggttctcttcttcgattttatgaaaatggagaactctgtgatgtcacactcaaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaaagataaaaaagcagaatcaatatgtgcacagttctctttatcaggcaaaaacacgtttattgagacatgaaatgagaatcaggctgaaggaatcatgcagctgaaagatgattatattcatagaaatgaagagatgaaatattcaaagaagatggctactttattgtgagacttaccactttaacctcatatgttaacagcacctaccaaaaaatgatatgagatagagctaaaatactgaaattgcaaatggacaaaataaatcatgaaaatttgtttattatttcttcaataaatatttctaggtgctttgtgattctttcatttagtcattaaagccattgctttactatattgcgttgccactttaaaaacaagttacttgacattgtttttgacagatttcactatattcttatgtaattaattgattatttctaaaatgtttgaataaactttgtactccctctaaggagtattttattcattcttttaattcccaaatgaactttgaacttacagtgctgttgaatgccttggtaaggacttcttgaaattgcataaactattcttgtaaatggtaaacttgagaattttctttgtttcttttttctctatgtcttaaagaatgcctttagaatctaattcatgttgtatcagttaagaatgtttctgtggtttctcgtatcagatgtgtaaagaaattattactgggatgccattggctatgtctctttccccttcatgtaaaattccaagtgtcagtaaaacttctctataatattttcttaaaaccatttataaatttgtgttataatactccagaaaatcaatgtaataagtggtcatatatatcaccaactatggatatcaaaaagttggggtcacatcagtgctatttatttaattaaaatacattgcatatttctattagcacaaacttctctctaaaaggtctgtgtaactgcttctcatcattatttgattgctgttatgggatcctgtcaaaactgtgtaattgtttattctccattcctcaaatacaaaattgagtaggttggctatatttttctccttatatgaaggatctttatgtttaactgaaaattttagaaagcttttcgttttcccttatgaaaattaaaggttgaaggtaactgatgtaagtagtttcactgatcttaagcagttgtctcttcagtaattgcagacttgtactatatagaaatgagactatgcattaggatgactgttgtccttccaagtagaaaccttgcaaagttgtagctttttaaaaaaattaaggttgccattgctaaaacttcttttgaaactcatctttgaaaatagcctgaagagatcatttgtaagtcactcaaaagaattagtctcatcatagtcatatgttaatcttgaccaaaatcttaacttgattattcatcaaacatgattgaaaatatttcatgtctattttcataggtaaaatctactttcaaagaagtgaggtttttcatctactggtaaaaatgttttcaacactaaacagtttgaatgaaatatttctaaaatcctgagcaatggcaaggtcagtgaaagaagtgtatagtctctttgagaggcaaccttatttgaatgcagaaattctggtgcgttttttgttgtttttaacaagtcactcttccattatcttagtggtttgaggctaagttcagtagaatataaggggtttcttagatatgagtaatagttatggggagtattagctatcatttaaaaaaatgtatcgcctgtaccagtcacttaataacatttctcatctttacagtaatttgatacttcaccgttaaaaaaaaggttcaaaagttaaaaagaaaatagattcaaagacattaaataactagttgaagatcacaactaagttagtgattgactaatattctttgtgactaaaaaactcaactgctccacctatatcagttatacatacttctgcattcactaggtaatacagtatgcatacattaagaaaagatcatttcctttttttgtagtctcttcttagcagtat

SEQ ID NO: 464056 - DNA, 211 bp, Homo sapiens
atcattgaagcaagtattgtcatctaaccctccaattgcataaattgggcctcctaaggaagccaaggcaattccttgcttcaatgatgtggagagatatgacatagaatctgatcagtggagtacagtggcaccaatgaatactccccgtggaggagttggctctgttgctctagtagtaagttatatggcaacttgtcattaaattaca

SEQ ID NO: 464057 - DNA, 6496 bp, Homo sapiens
ggggaaaaggcatcaacagcaccagcaaataaagaacagatgctcaattagtgatggtgatggacaagattcctttatttttgaagcaaatgaagcttggaaagattttcatggttctcttcttcgattttatgaaaatggagaactctgtgatgtcacactcaagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaaagataaaaaagcagaatcaatatgtgcacagttctctttatcaggcaaaaacacgtttattgagacatgaaatgagaatcaggctgaaggaatcatgcagctgaaagatgattatattcatagaaatgaagagatgaaatattcaaagaagatggctactttattgtgagacttaccactttaacctcatatgttaacagcacctaccaaaaaatgatatgagatagagctaaaatactgaaattgcaaatggacaaaataaatcatgaaaatttgtttattatttcttcaataaatatttctaggtgctttgtgattctttcatttagtcattaaagccattgctttactatattgcgttgccactttaaaaacaagttacttgacattgtttttgacagatttcactatattcttatgtaattaattgattatttctaaaatgtttgaataaactttgtactccctctaaggagtattttattcattcttttaattcccaaatgaactttgaacttacagtgctgttgaatgccttggtaaggacttcttgaaattgcataaactattcttgtaaatggtaaacttgagaattttctttgtttcttttttctctatgtcttaaagaatgcctttagaatctaattcatgttgtatcagttaagaatgtttctgtggtttctcgtatcagatgtgtaaagaaattattactgggatgccattggctatgtctctttccccttcatgtaaaattccaagtgtcagtaaaacttctctataatattttcttaaaaccatttataaatttgtgttataatactccagaaaatcaatgtaataagtggtcatatatatcaccaactatggatatcaaaaagttggggtcacatcagtgctatttatttaattaaaatacattgcatatttctattagcacaaacttctctctaaaaggtctgtgtaactgcttctcatcattatttgattgctgttatgggatcctgtcaaaactgtgtaattgtttattctccattcctcaaatacaaaattgagtaggttggctatatttttctccttatatgaaggatctttatgtttaactgaaaattttagaaagcttttcgttttcccttatgaaaattaaaggttgaaggtaactgatgtaagtagtttcactgatcttaagcagttgtctcttcagtaattgcagacttgtactatatagaaatgagactatgcattaggatgactgttgtccttccaagtagaaaccttgcaaagttgtagctttttaaaaaaattaaggttgccattgctaaaacttcttttgaaactcatctttgaaaatagcctgaagagatcatttgtaagtcactcaaaagaattagtctcatcatagtcatatgttaatcttgaccaaaatcttaacttgattattcatcaaacatgattgaaaatatttcatgtctattttcataggtaaaatctactttcaaagaagtgaggtttttcatctactggtaaaaatgttttcaacactaaacagtttgaatgaaatatttctaaaatcctgagcaatggcaaggtcagtgaaagaagtgtatagtctctttgagaggcaaccttatttgaatgcagaaattctggtgcgttttttgttgtttttaacaagtcactcttccattatcttagtggtttgaggctaagttcagtagaatataaggggtttcttagatatgagtaatagttatggggagtattagctatcatttaaaaaaatgtatcgcctgtaccagtcacttaataacatttctcatctttacagtaatttgatacttcaccgttaaaaaaaaggttcaaaagttaaaaagaaaatagattcaaagacattaaataactagttgaagatcacaactaagttagtgattgactaatattctttgtgactaaaaaactcaactgctccacctatatcagttatacatacttctgcattcactaggtaatacagtatgcatacattaagaaaagatcatttcctttttttgtagtctcttcttagcagtat

SEQ ID NO: 464058 - DNA, 4043 bp, Homo sapiens
gatttttcaattttttttctacttccgtaaatataaaagaaattgaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaaagataaaaaagcagaatcaatatgtgcacagttctctttatcaggcaaaaacacgtttattgagacatgaaatgagaatcaggctgaaggaatcatgcagctgaaagatgattatattcatagaaatgaagagatgaaatattcaaagaagatggctactttattgtgagacttaccactttaacctcatatgttaacagcacctaccaaaaaatgatatgagatagagctaaaatactgaaattgcaaatggacaaaataaatcatgaaaatttgtttattatttcttcaataaatatttctaggtgctttgtgattctttcatttagtcattaaagccattgctttactatattgcgttgccactttaaaaacaagttacttgacattgtttttgacagatttcactatattcttatgtaattaattgattatttctaaaatgtttgaataaactttgtactccctctaaggagtattttattcattcttttaattcccaaatgaactttgaacttacagtgctgttgaatgccttggtaaggacttcttgaaattgcataaactattcttgtaaatggtaaacttgagaattttctttgtttcttttttctctatgtcttaaagaatgcctttagaatctaattcatgttgtatcagttaagaatgtttctgtggtttctcgtatcagatgtgtaaagaaattattactgggatgccattggctatgtctctttccccttcatgtaaaattccaagtgtcagtaaaacttctctataatattttcttaaaaccatttataaatttgtgttataatactccagaaaatcaatgtaataagtggtcatatatatcaccaactatggatatcaaaaagttggggtcacatcagtgctatttatttaattaaaatacattgcatatttctattagcacaaacttctctctaaaaggtctgtgtaactgcttctcatcattatttgattgctgttatgggatcctgtcaaaactgtgtaattgtttattctccattcctcaaatacaaaattgagtaggttggctatatttttctccttatatgaaggatctttatgtttaactgaaaattttagaaagcttttcgttttcccttatgaaaattaaaggttgaaggtaactgatgtaagtagtttcactgatcttaagcagttgtctcttcagtaattgcagacttgtactatatagaaatgagactatgcattaggatgactgttgtccttccaagtagaaaccttgcaaagttgtagctttttaaaaaaattaaggttgccattgctaaaacttcttttgaaactcatctttgaaaatagcctgaagagatcatttgtaagtcactcaaaagaattagtctcatcatagtcatatgttaatcttgaccaaaatcttaacttgattattcatcaaacatgattgaaaatatttcatgtctattttcataggtaaaatctactttcaaagaagtgaggtttttcatctactggtaaaaatgttttcaacactaaacagtttgaatgaaatatttctaaaatcctgagcaatggcaaggtcagtgaaagaagtgtatagtctctttgagaggcaaccttatttgaatgcagaaattctggtgcgttttttgttgtttttaacaagtcactcttccattatcttagtggtttgaggctaagttcagtagaatataaggggtttcttagatatgagtaatagttatggggagtattagctatcatttaaaaaaatgtatcgcctgtaccagtcacttaataacatttctcatctttacagtaatttgatacttcaccgttaaaaaaaaggttcaaaagttaaaaagaaaatagattcaaagacattaaataactagttgaagatcacaactaagttagtgattgactaatattctttgtgactaaaaaactcaactgctccacctatatcagttatacatacttctgcattcactaggtaatacagtatgcatacattaagaaaagatcatttcctttttttgtagtctcttcttagcagtat

SEQ ID NO: 464059 - DNA, 4188 bp, Homo sapiens
ggggaaaaggcatcaacagcaccagcaaataaagaacagatgctcaattagtgatggtgatggacaagattcctttatttttgaagcaaatgaagcttggaaagattttcatggttctcttcttcgattttatgaaaatggagaactctgtgatgtcacactcaagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacatgcaagcccggtacatgcaagggtatgggcccggtacatgcaagggtacatgcaagcccgtacatgcccggtacatgcaag

SEQ ID NO: 464060 - DNA, 442 bp, Homo sapiens
ccattcggactaccccaaggaagcatactgctggtaaccaaattattttgtcaattctcctggaaggatctttgttgtatttgagggttgttcatgtgtgcccaaacttagttgtaatataattagtgtctgattgccttaaagtaataattggcaaatacggttttatatatttataatttttactgtacattatttagttttaccaataagccagttttttaaaaagccgtaatcagtcctgtatactctgaagagcctactgaaatatctcttcttttgagatctttcccgattctgaacttggtttactatgttgcattgtcatttactcatttgacatgtcttaagttcttcaaagacagctgagtatcttatttaggtttctatccctagggccaagcatggaacttgaaatatattgtgcatctaaatatttgtt

SEQ ID NO: 464061 - DNA, 694 bp, Homo sapiens
tccgcggggccgcgcaggagagcgcgcgtccgccgggtgctcgcgcggggttggtgaggttccgctgagggcggccggggctctgggagcgtggtaacgtggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttga

SEQ ID NO: 464062 - DNA, 5968 bp, Homo sapiens
tccgcggggccgcgcaggagagcgcgcgtccgccgggtgctcgcgcggggttggtgaggttccgctgagggcggccggggctctgggagcgtggtaacgtggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaaagataaaaaagcagaatcaatatgtgcacagttctctttatcaggcaaaaacacgtttattgagacatgaaatgagaatcaggctgaaggaatcatgcagctgaaagatgattatattcatagaaatgaagagatgaaatattcaaagaagatggctactttattgtgagacttaccactttaacctcatatgttaacagcacctaccaaaaaatgatatgagatagagctaaaatactgaaattgcaaatggacaaaataaatcatgaaaatttgtttattatttcttcaataaatatttctaggtgctttgtgattctttcatttagtcattaaagccattgctttactatattgcgttgccactttaaaaacaagttacttgacattgtttttgacagatttcactatattcttatgtaattaattgattatttctaaaatgtttgaataaactttgtactccctctaaggagtattttattcattcttttaattcccaaatgaactttgaacttacagtgctgttgaatgccttggtaaggacttcttgaaattgcataaactattcttgtaaatggtaaacttgagaattttctttgtttcttttttctctatgtcttaaagaatgcctttagaatctaattcatgttgtatcagttaagaatgtttctgtggtttctcgtatcagatgtgtaaagaaattattactgggatgccattggctatgtctctttccccttcatgtaaaattccaagtgtcagtaaaacttctctataatattttcttaaaaccatttataaatttgtgttataatactccagaaaatcaatgtaataagtggtcatatatatcaccaactatggatatcaaaaagttggggtcacatcagtgctatttatttaattaaaatacattgcatatttctattagcacaaacttctctctaaaaggtctgtgtaactgcttctcatcattatttgattgctgttatgggatcctgtcaaaactgtgtaattgtttattctccattcctcaaatacaaaattgagtaggttggctatatttttctccttatatgaaggatctttatgtttaactgaaaattttagaaagcttttcgttttcccttatgaaaattaaaggttgaaggtaactgatgtaagtagtttcactgatcttaagcagttgtctcttcagtaattgcagacttgtactatatagaaatgagactatgcattaggatgactgttgtccttccaagtagaaaccttgcaaagttgtagctttttaaaaaaattaaggttgccattgctaaaacttcttttgaaactcatctttgaaaatagcctgaagagatcatttgtaagtcactcaaaagaattagtctcatcatagtcatatgttaatcttgaccaaaatcttaacttgattattcatcaaacatgattgaaaatatttcatgtctattttcataggtaaaatctactttcaaagaagtgaggtttttcatctactggtaaaaatgttttcaacactaaacagtttgaatgaaatatttctaaaatcctgagcaatggcaaggtcagtgaaagaagtgtatagtctctttgagaggcaaccttatttgaatgcagaaattctggtgcgttttttgttgtttttaacaagtcactcttccattatcttagtggtttgaggctaagttcagtagaatataaggggtttcttagatatgagtaatagttatggggagtattagctatcatttaaaaaaatgtatcgcctgtaccagtcacttaataacatttctcatctttacagtaatttgatacttcaccgttaaaaaaaaggttcaaaagttaaaaagaaaatagattcaaagacattaaataactagttgaagatcacaactaagttagtgattgactaatattctttgtgactaaaaaactcaactgctccacctatatcagttatacatacttctgcattcactaggtaatacagtatgcatacattaagaaaagatcatttcctttttttgtagtctcttcttagcagtat

SEQ ID NO: 464063 - DNA, 961 bp, Homo sapiens
cttctgaaccaggatgagccaggaaaaggactttcacaagcacgaacatacaggaaatcaacattatcagttccctggcctctgctggtattgtgaagtaatttttgaaacttggaaatattacgatcgggtccatctatctaagtggaggaggcagctgtggcctggaggagttgtcgcttcctccaggtcatgtgtgagtcagtctgatacagccgagaagcacatcaggcagggctccttccactacctcacgctgcctctcttcctctgggtgcctttaatgaggggtcagtgcttactggttgctccccagggaaacctctcaggaaggggcttctgtgttagcatagtgtcaagctccccaggggattccagtggcagccagggtccaggacacgtcagaggcacgtcagtggcacgtcagtgtgctcagcggcggggtcctggggcctggtttgtatatagatttggcggcttttccattgctcctgcattctgggactgctttccaaaaaccctcctccagagtacagtagtcaagaatctcctctcagaaggcaggaccgactacacagggctgaaggaggcaaacaccctcaaggctgagtgtgcggaattaccttgtagatgccaaggggaggaaaaggctgaggagccccagagaaagctccattgccatgacgtcattttatggacagaaagttccattctcctcctctgcaagtgttgtagcctgacatggggccaggctaggaagaatgctgcgagccctctttggagtgacacggactgtatggatcatcagcagacacactttatgtaaaggagaaggagctgttgaagcgtcttgaaaacctactgaattgctgagcaggagagtatgtactaaagcagatcctaagaatactaattattcagatatggacactgagccattggtgcctattttattcactct

SEQ ID NO: 464064 - DNA, 1291 bp, Homo sapiens
tctgcgctccggaactgcatggacgagttaagagtgcccatgttgctcagcttctcagacacattcattccagagtctttgctgaggcagagctctctaaggagatgtttaagaatgggccaggtggcaaagtctcagcattttccactcattacatattgcaaggatcagcaatttgccattcctggtcatagacaacatgcctttggattgcaatggcccattatcacccctgctactgattattcctgtctcctactggggcctccaacttcctcttccgtgacaaaacctaaagcagtgttacgagcactttgcaaaattacttggcaatatttactaaagctaaatacacatatacgtatatgaattataaataaagccgctctgaatatccttggccattttttgtggacttatgaatttctgttggaagcactcctttcccctctaactacgaacagaactggagagctactttctggctgggtgacttggggaaatttgtaaacctcttgagatgcatcagtaagatgggcataatgacaggaaatcagcagctccaagagggcagaaactgtgctcctgtttgctagccctgacctcatacctggtattcagtatgcaggaagaaggtttagtaaggcctaaaattccccaaggaaagaaagcatgcctcaagactgtgaatgccctccagacatttacaactcatactgatgatttagctccctttcagtagggtctttcctatattatttattatttatgtgctggggcagagacatgaagaaaatggagctgtttagaacaggagtttgcaaactgcaatggccagtgaaccaaatccagctcaccgctcactgcctgtttttctaaataaagttgtattggaacacaaccacacctattcatttgcatattgtcgagggttgctttctggaccatggggtgtgtgtgtgtctgtgtgtgcgtgctcaagcacatgtgtgatagggaggtgggagctgcaagctaaatttgccagagaactctggctgcagcacatagtccagggcagtatcagtacccctacatcctctggaggatctggcagaagaatcccacctgatggcaaggagacacagatatcaggtcatttccctctcaagcagagctctgttttcttaattaacagagagggtttttccctgccaaataatgcaggctttatgagaggtgctcagggtgatgatagagttaaacgcagtgatttatccatatcccaagggtcagtgtgactgggagctac

SEQ ID NO: 464065 - DNA, 540 bp, Homo sapiens
catttactccatggccactgggccgtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccacaagctcctctacgccatggagtaaatgcagggatcctctagaacgccac

SEQ ID NO: 464066 - DNA, 517 bp, Homo sapiens
tcacggctgtccgtgtgtcgccaggcttcgctgagctgcagacagacatgacagatctcaccaaggagctgaaccgcagccagggcatccccttcctggagtataagcacttcgtgacccgcaccttcttccccaaggtcagcccgagcctgagcctgccctgaacctgtgccagccacctcaaggcaactcgacctctctgagccctgccagcctatagggtcccttgagcagtgccaaacctgcacagctgtccgcagccgtcctggccacttgccctggcctgccacggggagaagggttggaggcagattctccactgtcattctctgctcacttgatgtttaacagtccatatggaagccagctgcagccccgctgtcctggccagctgggcctgcctctccccttttcaaggtggggcagaagcggccagggctgtcccaggccagcctctctccttcctgtgcctcttcccagccaggcttcccttggtctctacactccctcctcctgt

SEQ ID NO: 464067 - DNA, 354 bp, Homo sapiens
gcctgacctgcctctccactgcccgcagccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaaggtcagcccgagcctgagcctgccctgaacctgtgccagccacctcaaggcaactcgactacactgagtacacagcgaagggttcatcaagggcagcggtacgtta

SEQ ID NO: 464068 - DNA, 7611 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgcaaaaaattcccccgggggggcccaagttttccgcggatccccgcgttttctttgtcaccaagggggcggcccattatgaggggcgcgagtattattaagccgaagaggagcaccgggccggggcctggttataacccagcgctttctgttcgcggggagaaaactcgtcgcctagcgggggcggggctcttgtgggggagggagcccctctatcttcttgtgggggcgggggcgcaaccttcctgtggggcaccaccctcccgcaaaccgagaagattattaaacgcgcctctaagcggggaatactataacaccattttcacgggttgcttattcgtggtgttcacacccagcggtacttattgtcccgtgcgcgtcctagaaatatttgtgccaccggcgagctcttgattttggtgcaacaaacttttttccccggacggtggtgtgtgttataattag

SEQ ID NO: 464069 - DNA, 7139 bp, Homo sapiens
  misc_feature (155)..(155): n is a, c, g, or t
  misc_feature (7036)..(7036): n is a, c, g, or t
  misc_feature (7038)..(7038): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataaagctnangaaaactaaaaagaaaaaaataaaaaacacggagatatgggagaaaagatgaaggaggaaagttcgaccgttttaagggaaagggacaagagacaatacga

SEQ ID NO: 464070 - DNA, 7083 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464071 - DNA, 5181 bp, Homo sapiens
taaatcagctcggtcccatggttagcagaggcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464072 - DNA, 2408 bp, Homo sapiens
gacttaggctagtaggaggccgggttttaaatcggccgaggccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464073 - DNA, 2062 bp, Homo sapiens
ggtccctccatcccgggtcactgttgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464074 - DNA, 1854 bp, Homo sapiens
cctggcttgctcaggtctcctggcttgctcaggtctcctgcttgctcagttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464075 - DNA, 1856 bp, Homo sapiens
cttgtgacaaggctccaacctcaggcccttgagggacaaagccagctctctcctccacaactgtccctcgactgcttcctaccccaccctaccctcactgtctttgtcaccctaccccacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464076 - DNA, 1429 bp, Homo sapiens
cccacgaactgaggcagggctaccggccatggcccggctgactccgctgctcccctcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464077 - DNA, 5612 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacaggtggcgggtgggggggccgtgtggacttcactgtgccactggggcccctgtggcagggggttcagagtctagtcttctggcctcgcctgcttggggtcaagccctcctctgccatttcccagctgtgtgttctcggatgagtgacttagcctctctgtgcttcagttccc

SEQ ID NO: 464078 - DNA, 5194 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtgggtaaggagccccaccctcaggacaccttggagggcaggcttgccaccttgccccagcccctctgaagattggcagatgggagaaggcaggatgggatggggcacagcttgaacaaaggcttggccatgggaacaggttaggcacccagaggttgggggaggtgtgccctggctccagcaccaatgggtagaagatgttaggtggccaggggatatgctaggcccacgcccaggtccctgaatctcaagcagagaaatttggaaccatgttctccagtcaatagagagctactgaaggtacttaagagaggattactcaggaaaaattaacctacatgtctggtgggctataccactgttaaaataatggtcaataaagtaatagactcgatgtagcagagaaactggagccatcatacgctactagagggaatacaaaaaagcgcagctgctttggaaaacattttggaagtttcttaggatgtgaaacatagaattaccctatgacctatgacccagcaattccacccctagctatctgctcaagagaaatgaaaacgtagccacacaaaaacttgtacacacgtgtttatagcaacattatttataataaccaggaagtcaaaacaacccaaatgtccatcaaccaataaatgaataaatgaaatatgaaaaaaaaaaaaaaaaaaaaaaaaaaaaaaaaaaaaaaaagggggggggcgcaaaaaattcccccgggggggcccaagttttccgcggatccccgcgttttctttgtcaccaagggggcggcccattatgaggggcgcgagtattattaagccgaagaggagcaccgggccggggcctggttataacccagcgctttctgttcgcggggagaaaactcgtcgcctagcgggggcggggctcttgtgggggagggagcccctctatcttcttgtgggggcgggggcgcaaccttcctgtggggcaccaccctcccgcaaaccgagaagattattaaacgcgcctctaagcggggaatactataacaccattttcacgggttgcttattcgtggtgttcacacccagcggtacttattgtcccgtgcgcgtcctagaaatatttgtgccaccggcgagctcttgattttggtgcaacaaacttttttccccggacggtggtgtgtgttataattag

SEQ ID NO: 464079 - DNA, 4611 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaaggtcagcccgagcctgagcctgccctgaacctgtgccagccacctcaaggcaactcgacctctctgagccctgccagcctatagggtcccttgagcagtgccaaacctgcacagctgtccgcagccgtcctggccacttgccctggcctgccacggggagaagggttggaggcagattctccactgtcattctctgctcacttgatgtttaacagtccatatggaagccagctgcagccccgctgtcctggccagctgggcctgcctctccccttttcaaggtggggcagaagcggccagggctgtcccaggccagcctctctccttcctgtgcctcttcccagccaggcttcccttggtctctacactccctcctcctgt

SEQ ID NO: 464080 - DNA, 473 bp, Homo sapiens
ccgccgccgtcgttgacccagcccgccaggcgctactgaccgtcgcttcctccggtcccgggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464081 - DNA, 563 bp, Homo sapiens
tccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggtcagctgttcccaggaccaggccaggcccatgcacagggccagagtggggtgccgaccatgggtagcctcctcgactctctgaggctgagctcagagatcttcctgggaggggaaccaaaagatctcaggtctaggggatgtgggatgagtgactcattcagacagggagacacctagaagccagtaccttccatcagaaactctgtatcgctgcagaccaactgcacatgctgcagctgtgcctggcactggctttgaacacaggcctgagaacccggtgtgggaaagccagtatgagcttggacaacctgcttggtcaggcacaacatcatctgaaaaccgggccaggctctgggcagtagcccctgaaagtcaaaagccattcaagcgagcattcagtgaaggggtgggcagaggggtg

SEQ ID NO: 464082 - DNA, 385 bp, Homo sapiens
gcatggtttagagatctgtgactggcccagaggggccgtaggaaatacacgtgagcagagactgaactggctttccttttgggaggccgtgcatcaggcgtgtggaagagccgtcatctaccagcccagcagacgttctcatgatcagagacccttttgtcccacccccgtgtcttatagttgcagaactgtgggaaactgatggggtaaattatacatagaaggcattggaagtgtggcatggcgtggaatggggcgatccctgagcctggctctagggtggccgtgggggccaaggaccgctggctgaccacagcacctcccctcaggatcgtgtgtgtcacagggccagccccaggaccgctctcaggtgtggtgaccgtga

SEQ ID NO: 464083 - DNA, 405 bp, Homo sapiens
gatgaggcggcactgagaccctgggacccacagctcctagggcctaaaggtgcagttgacacctgcctcccgctcacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggtgaggctgcctggggacagacagagcccaggcgggggacgtggcagggactcagcggcagtgaccccacggcctcccaggccttccctggcaccctcaggccagctctgccaggagggagtgttgc

SEQ ID NO: 464084 - DNA, 303 bp, Homo sapiens
ggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctactgtgggctccagcctttgtcctgagatagccaagcgggagaatgggcagtttct

SEQ ID NO: 464085 - DNA, 216 bp, Homo sapiens
gtaagctgcgacatccagattgtctctgacagaatcatccactgctcggtcaacgagtccctgggcgcggccgtggggcagctgcccatcacagtgagtggatggggcgccggagcagggcagacctggccccacccctggcccatctgccaagcatctgcccctcacccagcacctgaattcactgagcgttttcacgctcaacagctcagtcca

SEQ ID NO: 464086 - DNA, 6106 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacacttcagccctctggctggacactttggatgatgaggccttgatgggcagcccagcctttctagggcccttgggggcctctgtcttcctggacaaatgtgcagagtggctggagggttaacggaagcacttgctctaggcaaagcactagtgctccaagcccaccaaagccaacgtctaacgggcctgtcagctc

SEQ ID NO: 464087 - DNA, 7209 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464088 - DNA, 2919 bp, Homo sapiens
catcttacggctaggacaggccgggtggtaatcggccgaggaggcacaggaaacctacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464089 - DNA, 7176 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464090 - DNA, 3620 bp, Homo sapiens
cacgccgactcttgaggatcaacagcggcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464091 - DNA, 7427 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcgggcccctcgcagccaactcagccagtgttgggactggctcagagcccatgggggctggaggggggcagctgggactctggaatcttctttataataaaagccttacggacaaacctaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgcaaaaaattcccccgggggggcccaagttttccgcggatccccgcgttttctttgtcaccaagggggcggcccattatgaggggcgcgagtattattaagccgaagaggagcaccgggccggggcctggttataacccagcgctttctgttcgcggggagaaaactcgtcgcctagcgggggcggggctcttgtgggggagggagcccctctatcttcttgtgggggcgggggcgcaaccttcctgtggggcaccaccctcccgcaaaccgagaagattattaaacgcgcctctaagcggggaatactataacaccattttcacgggttgcttattcgtggtgttcacacccagcggtacttattgtcccgtgcgcgtcctagaaatatttgtgccaccggcgagctcttgattttggtgcaacaaacttttttccccggacggtggtgtgtgttataattag

SEQ ID NO: 464092 - DNA, 6885 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgtgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464093 - DNA, 1580 bp, Homo sapiens
  misc_feature (38)..(38): n is a, c, g, or t
gatcgctgtctctagagcataaaataaaggcgagtganttaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaacggcacgagggggggccccgtaccacaatttgcccttatagtgaggtgtatttacaatttaactggccgccggttttacaaccttttggactgggaaaaaccctgggctttaccccaaactttaaacggctttgctgaaaaataccc

SEQ ID NO: 464094 - DNA, 6444 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgcaaaaaattcccccgggggggcccaagttttccgcggatccccgcgttttctttgtcaccaagggggcggcccattatgaggggcgcgagtattattaagccgaagaggagcaccgggccggggcctggttataacccagcgctttctgttcgcggggagaaaactcgtcgcctagcgggggcggggctcttgtgggggagggagcccctctatcttcttgtgggggcgggggcgcaaccttcctgtggggcaccaccctcccgcaaaccgagaagattattaaacgcgcctctaagcggggaatactataacaccattttcacgggttgcttattcgtggtgttcacacccagcggtacttattgtcccgtgcgcgtcctagaaatatttgtgccaccggcgagctcttgattttggtgcaacaaacttttttccccggacggtggtgtgtgttataattag

SEQ ID NO: 464095 - DNA, 5182 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgcaggcaggagattagttcggcggccacagtggggggatcctc

SEQ ID NO: 464096 - DNA, 5101 bp, Homo sapiens
  misc_feature (155)..(155): n is a, c, g, or t
ccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgngccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctaccggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcgtgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccgctctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaaatccaggtagggaacttcaaccagaccatcgccacactgcagctggggggcagcgagacggccatcatcgtgtccatcgtcatctgcagcgtcctgctgctgctctccgtggtgggtaaggagccccaccctcaggacaccttggagggcaggcttgccaccttgccccagcccctctgaagattggcagatgggagaaggcaggatgggatggggcacagcttgaacaaaggcttggccatgggaacaggttaggcacccagaggttgggggaggtgtgccctggctccagcaccaatgggtagaagatgttaggtggccaggggatatgctaggcccacgcccaggtccctgaatctcaagcagagaaatttggaaccatgttctccagtcaatagagagctactgaaggtacttaagagaggattactcaggaaaaattaacctacatgtctggtgggctataccactgttaaaataatggtcaataaagtaatagactcgatgtagcagagaaactggagccatcatacgctactagagggaatacaaaaaagcgcagctgctttggaaaacattttggaagtttcttaggatgtgaaacatagaattaccctatgacctatgacccagcaattccacccctagctatctgctcaagagaaatgaaaacgtagccacacaaaaacttgtacacacgtgtttatagcaacattatttataataaccaggaagtcaaaacaacccaaatgtccatcaaccaataaatgaataaatgaaatatgaaaaaaaaaaaaaaaaaaaaaaaaaaaaaaaaaaaaaaaagggggggggcgcaaaaaattcccccgggggggcccaagttttccgcggatccccgcgttttctttgtcaccaagggggcggcccattatgaggggcgcgagtattattaagccgaagaggagcaccgggccggggcctggttataacccagcgctttctgttcgcggggagaaaactcgtcgcctagcgggggcggggctcttgtgggggagggagcccctctatcttcttgtgggggcgggggcgcaaccttcctgtggggcaccaccctcccgcaaaccgagaagattattaaacgcgcctctaagcggggaatactataacaccattttcacgggttgcttattcgtggtgttcacacccagcggtacttattgtcccgtgcgcgtcctagaaatatttgtgccaccggcgagctcttgattttggtgcaacaaacttttttccccggacggtggtgtgtgttataattag

SEQ ID NO: 464097 - DNA, 1484 bp, Homo sapiens
ggttcactctgtcaccagctcccatccccaagcccagcagaaggccaccttgctctgccccatctaatggctaaggaccaaatagcacaggcagggaggacaagaaacaggaaaaagaagcttgctgagagttttcaaacctacatcaacagagaggagcaacttgccctgagtgcctactacttgacaagcacgaaaactacatcattcttcatccttacaaaatctttagactgggtaacagcattcccattatatgaagaaactgaggagctgaccaaagagggtgctggctcccctgctccttcctccagtctggtgcaccatgatgactgtttggaagttgactttgatagacaagaggatgtttgtgcactgctggaagagactgtgaagggaagcctcactctccacagtgtgatggcttccttctatgagctcaacggcagtctcatctatagtaataacatcctacctgacatgagtatagtactttacaattctttcataccatttggggaggttcttcctaacccctcgattaagcagttgaagtggtaggaaatttttacataggagagtatggtgatcatatttgcattttagaaaataatggatagcagtttgttaggggaacaaaggacagagacagggagactatttaaaacattaataaaaaataccagtgacagatgatgaggcacctacctgatgggaatggagaagaggagatggattcagaaactacttaggagaggcaggcagtccaaggctgatgcccaaagaagccatcaagacccgtgctacttccagctccttctgtcctcataatcatagatgattgctccacatccagagtctcgctcagtttccaggctggagtgtaatggcgtgatcttggctcactgcaacctctgcctcccagcttcaagtgattcccctgctttagcctcccaagcagctgggactacaggcatgcaccagcatggccggctaatttttttttgtattttagtacagatgggatggaccacagggaaaccactgcagcaaactaaaagtgtctatctcagatccttccaccaccatcatttccaaaatcaccgtcactatctccaccaccatcacctttaccaccatcaccactatcatcctcatccttcccatcaccatctccactgctatctctcaacaccatcatcatcaccaccaccaccatcatcaccatgagcaccacctctgtcgtcatcaaaaaagcacacagttcaggctggcctgttggaggataacagatcatgtggagcagagacgagctggcccacctcaggccctaccagagcaatcagcttgccaaacacgacatacatcagcgaggccatcctagaccatccagccctagctgagccagcccagaccagagactcatgagaaacagtaaaatgttcatcattttaagccactagattttgtggtggtttgttata

SEQ ID NO: 464098 - DNA, 1771 bp, Homo sapiens
cgaagcctcaagcgtcacgtctaggaatagcgctggagtcgggccaagtcattagagacgatgagtaatctggctcttccagaccttcctgagtggtagtggccacggctgaagacagagggctgcgtggaggctgaaggcagagggctgggccttgggcctgggtaaagacagctctggacatggagtggcaggagcgataagcagaactactggtgacactgtgggagagaaattctgcaaaataacagctgggcagcccgggaccccagggagttgaaatgggacctcggagacatcaggatgtcctggagaggcaccaaggccagaggtcccccagggaccgtggagggggcattaagccctgaaaacagatcatgatgcccatccccccagcacaattagaaataaaaacaacccgggacagttaaattagtgtaaggaagtccctcaagagttttacttttcccgtaacggcgattttcgatgctccttcggaaacatcagattctttccaagcgttattctttttctattttggtgcccgaagtactagcgtggtggaccaagcccctacaccagccgtgagcgacccctgcgggctgcctggcccctgtgggcactggctccggggatgcggcagggggcggagggggcgacaccgggcttggggggcgggcagcggagggaggactgggggtggggaggggggagggcggggagggcgcccagcggcgcggccgcgccccccaccccaccccattccacccccaccgaggaccgcgctggggtttcagaaagcgcttttctggccctgccgccggatctgactcaaaaaggggagctggctcaaaccgaaagaataattcggttagccaaagcgccgatatttccctggggcccaaatggctgccaggcagggggctccagggccgcagcctcgccggcccctcgggccccgccgaaagccccgggccccatccatcttcgccaccgaaaggggcaggaagagcagctgagaggagggcgcctcctccagccccgcaggctctgctgccggaccgtcgtgtccctcccgaggccttcccctgcctgtcccagcgggccctgctctctcgggttctcaggacatagatccagattgaagagttgaggagctgcctggaagtggggagcccacgggactcccagctccatgaaactgctcctgctggctgtggagggggaggaagcagccacagatggggagggtggcaaccaggcacctacccctgcagggccgctgccttgcccccacaggtgtagcactatccgcccagggatgaggcctgggtgcctgctggtgccctgtgtcagagtccccatctgtaatacaccccagtcccacagccagtgggtggtagagtccccactctgtgctgctgactgtgctaggctatttcatggcacttgcaaaggctcagcacatcatgggcccccagtgtgtgctgactgtatggctgaaaggattgatgagacactaaagtcccccatgaaggcacaaaccagaagtagaggtggttctcagctacaacagctcccctgcccacccacccacagtgcccccacagctgagttcctgcgggctgggtgccaggcgatgtgcatgcagcacatgtgagtcccaggggcatggggtctcccagcgctcagagcctcccaccaccctgcacccagggtgccatgccctctctctttccctgcaccctatggctgctgttttccctcaata

SEQ ID NO: 464099 - DNA, 1867 bp, Homo sapiens
tgtacatgtacccgattactaatgagattgagcatcttttcacatttctgtggaccattccagaggtactgcctttatggtcttgggcaagatcctgaagaattccctggattactagacagagactcttgttctcttcacttactttctaccaaacaaatcaattctctccctctgttacaagcctcctggagctgggagtggagtgacaaaaacacgtctatagctaccacccttaggactgcactgggtttctcccaaaacctgttgcaaccactccctgactactgcctatgtttgctcaatgccctgaggctctacaatcatcaagtggcaaagccagccaggcttatatccttccccagggcctgggcaagtccagaggtgccaactgggggccagggactagagtcaaaaaccttagatgtgtacctgatgctccattgtactgcagctgagctgacttttaaaccataagacacagtccttcccactcttccctcttcttttcaatggcagagaagcctcactttgtggccaccaccacctcaggcccatgaggagtactaccagactattgctcatgttcccttagggctaaggactcttcagtcagcttatggtgaatactgcctgatctgagactcacccttcagaggaatgggctcctgtatggcccagggcaggacacagaaacactgtcagcactacgccactgctgcttggtgatggggaagaggtggtgtcagtgattcaagcctgtttttcctacctcttcagtgcttctttcagcgctatgaagtaaaaccaggtaatctgcatctcattaattggaccataagaccaagcagccacacctcagttttatccgggtacaaaatctggcagctccactgggacagagctgccctcagcagctagaggcttgtgacctgacggtctttaggagactcccagcagctgctaggtacagtttgtcctgaggacgcttctgagaactttccctgggcaaaaggaccacccatccccttgctactggggtagaacaggggctaggacactgaagggatgggagcagcctggtaaccaatggaagaaagaatgctgtatatgctatggtgacctcttaagaggtagcagaggcaaggactttacgtgggaacctctgcacagaaggcagagcaaatcacccttataagagcctgcagttgtcccaaggagcattgtgaactctgaagaactgtgccacacattccagcccggtgatcaagtgctattaaaagaatggaaagaaacagaccctgcttcccagctgcaggagaaatacaaagggccctatgatgtgctgctaagcaccagttcagcactgaaactggtggacatcaagccatggatccactacacacgattgaaaaagttcctgcaagaagaaacatccacgacagaggacaccaaggccaccgaatgggagatggaacccctggaaggcctaagatttctgttcaacaaatgacaagattttcccttataatatttttcctttctgctccttttgttgttaatgcctctacctctaacgttttcctacaatgggcacacagttatgcagatggcttacaacaaggagacccttgctgggtctgtggttcgttacccgtcactaacaccatggagctaccttggtgggtctccccgctacaagggaaagactgggttttttttcaaagctttataggggatcttaaacaatggacaggggcacagatgactggggtaactagaaaaaacatttcagaatggcctataaataaaatagagcgccgataatgaaatttattggtcgacatattggttataaaaacaaatt

SEQ ID NO: 464100 - DNA, 1460 bp, Homo sapiens
tgtacatgtacccgattactaatgagattgagcatcttttcacatttctgtggaccattccagaggtactgcctttatggtcttgggcaagatcctgaagaattccctggattactagacagagactcttgttctcttcacttactttctaccaaacaaatcaattctctccctctgttacaagcctcctggagctgggagtggagtgacaaaaacacgtctatagctaccacccttaggactgcactgggtttctcccaaaacctgttgcaaccactccctgactactgcctatgtttgctcaatgccctgaggctctacaatcatcaagtggcaaagccagccaggcttatatccttccccagggcctgggcaagtccagaggtgccaactgggggccagggactagagtcaaaaaccttagatgtgtacctgatgctccattgtactgcagctgagctgacttttaaaccataagacacagtccttcccactcttccctcttcttttcaatggcagagaagcctcactttgtggccaccaccacctcaggcccatgaggagtactaccagactattgctcatgttcccttagggctaaggactcttcagtcagcttatggtgaatactgcctgatctgagactcacccttcagaggaatgggctcctgtatggcccagggcaggacacagaaacactgtcagcactacgccactgctgcttggtgatggggaagaggtggtgtcagtgattcaagcctgtttttcctacctcttcagtgcttctttcagcgctatgaagtaaaaccaggagcattgtgaactctgaagaactgtgccacacattccagcccggtgatcaagtgctattaaaagaatggaaagaaacagaccctgcttcccagctgcaggagaaatacaaagggccctatgatgtgctgctaagcaccagttcagcactgaaactggtggacatcaagccatggatccactacacacgattgaaaaagttcctgcaagaagaaacatccacgacagaggacaccaaggccaccgaatgggagatggaacccctggaaggcctaagatttctgttcaacaaatgacaagattttcccttataatatttttcctttctgctccttttgttgttaatgcctctacctctaacgttttcctacaatgggcacacagttatgcagatggcttacaacaaggagacccttgctgggtctgtggttcgttacccgtcactaacaccatggagctaccttggtgggtctccccgctacaagggaaagactgggttttttttcaaagctttataggggatcttaaacaatggacaggggcacagatgactggggtaactagaaaaaacatttcagaatggcctataaataaaatagagcgccgataatgaaatttattggtcgacatattggttataaaaacaaatt

SEQ ID NO: 464101 - DNA, 5744 bp, Homo sapiens
gagatcgggcgcgttcagggtgaggagccatgtaaggatcatgagaggaactcaagaaggaggggtgggctactgccagacttcccagagcagaagccatgtgaaggggaagttcactgacttggaaactcttgcaccacctgctgagtctggagggctgacagatgcggagcttgtgctgaaacttatggaaaacttagttttggcatctcacactcctggaaaactggctagcttaaaaaagaacgctttctcctcttttcctcaatccactccaactcaacctcagccttctcattttctaagaataatgtctactttgttgtccattgacagtgccctggggcattcacatgcaaagagacttagagaccaggataatttctgtggcctacaaatcatgaaaggggatgctctggggagagaaaggaaagagtgcaaactgaaatggcttttctccttgcatcaaaaatgccttgagctgcatcccttaacaccttaatggacacccaacagtcactgcactgataaggaagctactagaagctacttagcacagagttatcactcaatatgactgaccatcattcagtaactctgaaatgtaaaggatccaggtaatttctgtggccaatagttctcagccctcccaatacatagaaagcacctgggcgcttggcttattaaattggtagattcctgggcactgtcccagggatccattttatacctcacatttgggctctggaatctgcacttctaagaaagcctctgaattgttctgatacagacgatgcttagaccacactttaaggaacaccgcagaagtgtttcttattcgcagaataaaaggtttcatttccaaaaactgtttcgccaattagatcttctgttcatttatcccaccttctttactattgctgctttggaagaaaatcagattattgttggaaaattagaaaacacaggtgaataaaaatgaaaaatcaaactcacatccagagaaataactcatgctaaactgttaattttttgtgtatattcttaaaaaatgtatacatacacataatataaaatatttgtgtatatgtctatactttataggttgtttagttcacttaataaatcataaatgtctttgcatactggcaaatccataatatcttcatcatcacttttaatggttattccattaaacagatgtatggttattcagccagtgccctaacatcgaatatttagattttctcccaatagttctatcttataaaccaaacctgtgatgagcatttctgtacatatgcctacttgttcagtcatttcctaaggacaaattcctagtagcagaattatcaagtcaaaggataatagattttaaggctttgataaattgccaaatgtccccaagaaatgtttcctgatttactctctcagcggcactcaataaaaatgaggaaacaccccttcccaatctggatattataatttaaaaaaaaactattcccatatgctttgatagaaaaattgtttctattgttttaatgcgcagttatttgactcatagaatgaatctattctttcttactatatgtttgccacctaagattcttatgttacgagctgctttttcatatgctttgtccactatatttttgaaacatttgtcattttcttagttagtaggaagaactctttacactaacacttaacagtttgttaactatattttatgtgaacactttgttcactgcatatgtgcaaatatattacatatattaacactgtattggctacatatttgcaaatattcccagacattttaaatacttgttgatagtatttttaactggtttgcttttattgttgtacaagtatgattaacttttataaggcaaaaatgtatcattatgtttttagaatttctgtcttcaatgtcatatgtgacaagacctctcctccttcaaaattatataaatattcactcaaactttcttccagtattttgtagtttatttttacacttagatcttagattcatctgaaatttttttagagccacgagagcttaagaaaactcgtcctgctcagaagtccacctgttcagatttttatttatttagtttttaaggttatgctgattacataaactcagggaaagcttgactaaagtcatagggaatacattagggcagatatatcttatgtaggtgatcccacctgctggagcccaaaagaaaagaagaaaaagattccttctatttaaaaataaagcgatttatttaagcaaagagtatggatttatgctgcgctagatatctgcagaaaactcacattaatgttggccattgtgtggagggatgaggcatagctctaaataaaccaatatgctcaaggaataaggtgtcgtatgtgaagttatttcttttaaaataacatgaaaaactaaagtaataaaatgttaaaaataaaagaaataactttaccaatggtcctaaaccattccaaaaagtgaactactatttaccgttttctctcaaatttctgtccacgtgaattaataaatttggcataattttaatcatagtacagaacagcatttttatatatatcaagtccttcacttttgttgacatattgtttcaatttattatattgaagatctgcataatattcaagtaattagatgtgctcaataatttaattaataccatattgtggaattacattcttcataacatttttatgtaatataatattgcataaacgtcttgaagaatatacctggttccttttttttgccatgcaagtagaattattgggcaaaatagcatgcacattttctacttcttggcaataatatttaataatatatcacagtatattttggttctagcaatgtatgggtatattggtttgacaaccttgctagagatgcatattatctatatttttgaagttgtgctaaatggacatgtataaaatcttcttgataacatggttgactcctccaaatccagtatttattatttcaaattatgttattcaaaattttgcttaattagctcattggggaaaaccaaatattttaaatcattcaggtgctttcaagacctggggtttattattaaattactaaatgccaataatttttatatgactccatgtggaaatttggaagatatacaagatgtttctgaaggtgtatcgatgcccttttttgaccagtacttaacatgaacttaccgtgtactgtgtgattatttctctttttgaaagggaaccagagggtgcaaactctttatttgagggccctggtgtctcaaggttatactccagaaaatctcattctttcctttcccaactggcatttcaaagatatttcaagtactcatattaccagatattaagcacttcagcaagaaattatctaaatttcccaatttgctccttaaagacttcttgcagactctttttcaaatttgcctgtggagtgcagattttcttgtgcacaacactgaatttatttaggtagtagaaaccttcctaggtgatcctggttctctcaaaatgtgacagataagaaggccagttcataacagggcaaggtagatttttctggaaagtaacttgcagaaaaatgaaaggctaaaggtctaattagagatagaaattgttttttaacatattagttagtggtaaaaaaaataagtgaatgctttttcatgtccataacgctgcagggacacccttgaacatgtctctttataatatttctccaaagtatgtatctggaaatgacattaatggatggtaggaaatggacatcttcaaagttttccatcattgacaatattttctccaaaattcttttaacaatttagcacctccatcaataaggcatagaaatttctacttccttacattttcaagaaccctttgttatcagattttaattcctgtctaaaacttgtaaaagggtagggagtaattgttttaatgtgcattctctaatcactaatgaaatagagcagtttaacaacaacaaaaagaaaggaaagccctaatggccaatagaaagaataacttctgatgtttgatagaacagtggggtgcctacagttcataataatttattgaatatttcaaaatagcagaagaaaagatttgaaacattaccaacacaaaaaataataaatgtttgaggtgatgaataacctaaatgccatgatttgatcattatgctttatatgcatgtatcaaaatatcacatgtgccctataaatatgtgcaattattatgtatcaattttaaaaagattcgccagctgaagtcatctcactacaaatcaactgcaccaaatggtcattcaaccaacacagccccactcctcaagattttagatgacatttgtctttaaataatgaagatcgccctgcagggattattggattatctgttaccatgcaatgtcttagttactatttagtactttattaaaggttagttgaggataaggtaatatgctgaatggtttgggatgggacactacctggaagaaaggaaaggatattgattttaactagatagtatgtatcttacaaatggaattatattttacaataatagaagtggagtagtagttatttatgtaacacctacaattagacactatgctacagatttttgtatacagttgacccttgaacaacatgaaattaggggcactggccccacatacagttgaaaacccacatgcaatttttgaatccctaaaacttaactgctaataccctactgttgacctgaagccttactgatagcataaatagttgactaacatattttatatgttatatatattatatactgtactcttacaataagagagagagagagagagagagagagagagagagagagagagagagagagagagagagagagagattttagtttggagaaagaaaggccatggttacttttactatttatcctaaaaagaaattattgaaggacaagtgtaaaatgttgtcacgtgtaagggactaaatttagcctctccgatgtcagctagtggaagtgagtggaaggtacggatgcagacaacattgaaagagatcacattctaggaatgcaatgttacagcccaattagttcatgagaaagcatggttggaagatatattgtttctatttgtatgctatagaattctgaacggtaaacttaacatgatcagggaataagttattcctcacattttctgcatcctctgggagaggataacaaaggaagctgaggaagtctgttctggaggcaccatgacaaagcaccagacagaaagcagtcacgtgtggggagatgagcagagacaccacttctcaagcacctgattattctttctcagtatttagaagcaaaaattatccttaagaaaaacaaccgcaaacgcaacacaggctacacagatgagaaaatggggttccccatcttcgttgaaggccccacatcatttgccatgaacttgcagaatatttcaagagagaaggctgaaaaggaaggtgactggaatattaagaactgtgagatattctgaggaaactctaatttgtaaattggtagaaatgccagtaatttgttgggaattgaagaccctctgtattcaagagcgaagcttggcagctgtgcactgttgttttataaatcaatattacatctgaaagtggtgtttgaatgtttgtgtcatt

SEQ ID NO: 464102 - DNA, 5875 bp, Homo sapiens
gagatcgggcgcgttcagggtgaggagccatgtaaggatcatgagaggaactcaagaaggaggggtgggctactgccagacttcccagagcagaagccatgtgaaggggaagttcactgacttggaaactcttgcaccacctgctgagtctggagggctgacagatgcggagcttgtgctgaaacttatggaaaacttagttttggcatctcacactcctggaaaactggctagcttaaaaaagaacgctttctcctcttttcctcaatccactccaactcaacctcagccttctcattttctaagaataatgtctactttgttgtccattgacagtgccctggggcattcacatgcaaagagacttagagaccaggataatttctgtggcctacaaatcatgaaaggggatgctctggggagagaaaggaaagagtgcaaactgaaatggcttttctccttgcatcaaaaatgccttgagctgcatcccttaacaccttaatggacacccaacagtcactgcactgataaggaagctactagaagctacttagcacagagttatcactcaatatgactgaccatcattcagtaactctgaaatgtaaaggatccaggtaatttctgtggccaatagttctcagccctcccaatacatagaaagcacctgggcgcttggcttattaaattggtagattcctgggcactgtcccagggatccattttatacctcacatttgggctctggaatctgcacttctaagaaagcctctgaattgttctgatacagacgatgcttagaccacactttaaggaacaccgcagaagtgtttcttattcgcagaataaaaggtttcatttccaaaaactgtttcgccaattagatcttctgttcatttatcccaccttctttactattgctgctttggaagaaaatcagattattgttggaaaattagaaaacacaggtgaataaaaatgaaaaatcaaactcacatccagagaaataactcatgctaaactgttaattttttgtgtatattcttaaaaaatgtatacatacacataatataaaatatttgtgtatatgtctatactttataggttgtttagttcacttaataaatcataaatgtctttgcatactggcaaatccataatatcttcatcatcacttttaatggttattccattaaacagatgtatggttattcagccagtgccctaacatcgaatatttagattttctcccaatagttctatcttataaaccaaacctgtgatgagcatttctgtacatatgcctacttgttcagtcatttcctaaggacaaattcctagtagcagaattatcaagtcaaaggataatagattttaaggctttgataaattgccaaatgtccccaagaaatgtttcctgatttactctctcagcggcactcaataaaaatgaggaaacaccccttcccaatctggatattataatttaaaaaaaaactattcccatatgctttgatagaaaaattgtttctattgttttaatgcgcagttatttgactcatagaatgaatctattctttcttactatatgtttgccacctaagattcttatgttacgagctgctttttcatatgctttgtccactatatttttgaaacatttgtcattttcttagttagtaggaagaactctttacactaacacttaacagtttgttaactatattttatgtgaacactttgttcactgcatatgtgcaaatatattacatatattaacactgtattggctacatatttgcaaatattcccagacattttaaatacttgttgatagtatttttaactggtttgcttttattgttgtacaagtatgattaacttttataaggcaaaaatgtatcattatgtttttagaatttctgtcttcaatgtcatatgtgacaagacctctcctccttcaaaattatataaatattcactcaaactttcttccagtattttgtagtttatttttacacttagatcttagattcatctgaaatttttttagagccacgagagcttaagaaaactcgtcctgctcagaagtccacctgttcagatttttatttatttagtttttaaggttatgctgattacataaactcagggaaagcttgactaaagtcatagggaatacattagggcagatatatcttatgtaggtgatcccacctgctggagcccaaaagaaaagaagaaaaagattccttctatttaaaaataaagcgatttatttaagcaaagagtatggatttatgctgcgctagatatctgcagaaaactcacattaatgttggccattgtgtggagggatgaggcatagctctaaataaaccaatatgctcaaggaataaggtgtcgtatgtgaagttatttcttttaaaataacatgaaaaactaaagtaataaaatgttaaaaataaaagaaataactttaccaatggtcctaaaccattccaaaaagtgaactactatttaccgttttctctcaaatttctgtccacgtgaattaataaatttggcataattttaatcatagtacagaacagcatttttatatatatcaagtccttcacttttgttgacatattgtttcaatttattatattgaagatctgcataatattcaagtaattagatgtgctcaataatttaattaataccatattgtggaattacattcttcataacatttttatgtaatataatattgcataaacgtcttgaagaatatacctggttccttttttttgccatgcaagtagaattattgggcaaaatagcatgcacattttctacttcttggcaataatatttaataatatatcacagtatattttggttctagcaatgtatgggtatattggtttgacaaccttgctagagatgcatattatctatatttttgaagttgtgctaaatggacatgtataaaatcttcttgataacatggttgactcctccaaatccagtatttattatttcaaattatgttattcaaaattttgcttaattagctcattggggaaaaccaaatattttaaatcattcaggtgctttcaagacctggggtttattattaaattactaaatgccaataatttttatatgactccatgtggaaatttggaagatatacaagatgtttctgaaggtgtatcgatgcccttttttgaccagtacttaacatgaacttaccgtgtactgtgtgattatttctctttttgaaagggaaccagagggtgcaaactctttatttgagggccctggtgtctcaaggttatactccagaaaatctcattctttcctttcccaactggcatttcaaagatatttcaagtactcatattaccagatattaagcacttcagcaagaaattatctaaatttcccaatttgctccttaaagacttcttgcagactctttttcaaatttgcctgtggagtgcagattttcttgtgcacaacactgaatttatttaggtagtagaaaccttcctaggtgatcctggttctctcaaaatgtgacagataagaaggccagttcataacagggcaaggtagatttttctggaaagtaacttgcagaaaaatgaaaggctaaaggtctaattagagatagaaattgttttttaacatattagttagtggtaaaaaaaataagtgaatgctttttcatgtccataacgctgcagggacacccttgaacatgtctctttataatatttctccaaagtatgtatctggaaatgacattaatggatggtaggaaatggacatcttcaaagttttccatcattgacaatattttctccaaaattcttttaacaatttagcacctccatcaataaggcatagaaatttctacttccttacattttcaagaaccctttgttatcagattttaattcctgtctaaaacttgtaaaagggtagggagtaattgttttaatgtgcattctctaatcactaatgaaatagagcagtttaacaacaacaaaaagaaaggaaagccctaatggccaatagaaagaataacttctgatgtttgatagaacagtggggtgcctacagttcataataatttattgaatatttcaaaatagcagaagaaaagatttgaaacattaccaacacaaaaaataataaatgtttgaggtgatgaataacctaaatgccatgatttgatcattatgctttatatgcatgtatcaaaatatcacatgtgccctataaatatgtgcaattattatgtatcaattttaaaaagattcgccagctgaagtcatctcactacaaatcaactgcaccaaatggtcattcaaccaacacagccccactcctcaagattttagatgacatttgtctttaaataatgaagatcgccctgcagggattattggattatctgttaccatgcaatgtcttagttactatttagtactttattaaaggttagttgaggataaggtaatatgctgaatggtttgggatgggacactacctggaagaaaggaaaggatattgattttaactagatagtatgtatcttacaaatggaattatattttacaataatagaagtggagtagtagttatttatgtaacacctacaattagacactatgctacagatttttgtatacagttgacccttgaacaacatgaaattaggggcactggccccacatacagttgaaaacccacatgcaatttttgaatccctaaaacttaactgctaataccctactgttgacctgaagccttactgatagcataaatagttgactaacatattttatatgttatatatattatatactgtactcttacaataagagagagagagagagagagagagagagagagagagagagagagagagagagagagagagagagattttagtttggagaaagaaaggccatggttacttttactatttatcctaaaaagaaattattgaaggacaagtgtaaaatgttgtcacgtgtaagggactaaatttagcctctccgatgtcagctagtggaagtgagtggaaggtacggatgcagacaacattgaaagagatcacattctaggaatgcaatgttacagcccaattagttcatgagaaagcatggttggaagatatattgtttctatttgtatgctatagaattctgaacggtaaacttaacatgatcagggaataagttattcctcacattttctgcatcctctgggagaggataacaaaggaagctgaggaagtctgttctggaggcaccatgacaaagcaccagacagaaagcagtcacgtgtggggagatgagcagagacaccacttctcaagcacctgattattctttctcagtatttagaagcaaaaattatccttaagaaaaacaaccgcaaacgcaacacaggctacacagatgagaaaatggggcttgcagagctcaaaccattacaccattcagaagctggctttggtattacttcaagttattcaaaacagtcaccacttgctgagcctctgatgtctcatctgttgaatgggtacattttcttcctgatccttccacctctaaacttgtctatttccaaggatctatggcatccaggcatatgatttcaagagagaaggctgaaaaggaaggtgactggaatattaagaactgtgagatattctgaggaaactctaatttgtaaattggtagaaatgccagtaatttgttgggaattgaagaccctctgtattcaagagcgaagcttggcagctgtgcactgttgttttataaatcaatattacatctgaaagtggtgtttgaatgtttgtgtcatt

SEQ ID NO: 464103 - DNA, 5803 bp, Homo sapiens
gagatcgggcgcgttcagggtgaggagccatgtaaggatcatgagaggaactcaagaaggaggggtgggctactgccagacttcccagagcagaagccatgtgaaggggaagttcactgacttggaaactcttgcaccacctgctgagtctggagggctgacagatgcggagcttgtgctgaaacttatggaaaacttagttttggcatctcacactcctggaaaactggctagcttaaaaaagaacgctttctcctcttttcctcaatccactccaactcaacctcagccttctcattttctaagaataatgtctactttgttgtccattgacagtgccctggggcattcacatgcaaagagacttagagaccaggataatttctgtggcctacaaatcatgaaaggggatgctctggggagagaaaggaaagagtgcaaactgaaatggcttttctccttgcatcaaaaatgccttgagctgcatcccttaacaccttaatggacacccaacagtcactgcactgataaggaagctactagaagctacttagcacagagttatcactcaatatgactgaccatcattcagtaactctgaaatgtaaaggatccaggtaatttctgtggccaatagttctcagccctcccaatacatagaaagcacctgggcgcttggcttattaaattggtagattcctgggcactgtcccagggatccattttatacctcacatttgggctctggaatctgcacttctaagaaagcctctgaattgttctgatacagacgatgcttagaccacactttaaggaacaccgcagaagtgtttcttattcgcagaataaaaggtttcatttccaaaaactgtttcgccaattagatcttctgttcatttatcccaccttctttactattgctgctttggaagaaaatcagattattgttggaaaattagaaaacacaggtgaataaaaatgaaaaatcaaactcacatccagagaaataactcatgctaaactgttaattttttgtgtatattcttaaaaaatgtatacatacacataatataaaatatttgtgtatatgtctatactttataggttgtttagttcacttaataaatcataaatgtctttgcatactggcaaatccataatatcttcatcatcacttttaatggttattccattaaacagatgtatggttattcagccagtgccctaacatcgaatatttagattttctcccaatagttctatcttataaaccaaacctgtgatgagcatttctgtacatatgcctacttgttcagtcatttcctaaggacaaattcctagtagcagaattatcaagtcaaaggataatagattttaaggctttgataaattgccaaatgtccccaagaaatgtttcctgatttactctctcagcggcactcaataaaaatgaggaaacaccccttcccaatctggatattataatttaaaaaaaaactattcccatatgctttgatagaaaaattgtttctattgttttaatgcgcagttatttgactcatagaatgaatctattctttcttactatatgtttgccacctaagattcttatgttacgagctgctttttcatatgctttgtccactatatttttgaaacatttgtcattttcttagttagtaggaagaactctttacactaacacttaacagtttgttaactatattttatgtgaacactttgttcactgcatatgtgcaaatatattacatatattaacactgtattggctacatatttgcaaatattcccagacattttaaatacttgttgatagtatttttaactggtttgcttttattgttgtacaagtatgattaacttttataaggcaaaaatgtatcattatgtttttagaatttctgtcttcaatgtcatatgtgacaagacctctcctccttcaaaattatataaatattcactcaaactttcttccagtattttgtagtttatttttacacttagatcttagattcatctgaaatttttttagagccacgagagcttaagaaaactcgtcctgctcagaagtccacctgttcagatttttatttatttagtttttaaggttatgctgattacataaactcagggaaagcttgactaaagtcatagggaatacattagggcagatatatcttatgtaggtgatcccacctgctggagcccaaaagaaaagaagaaaaagattccttctatttaaaaataaagcgatttatttaagcaaagagtatggatttatgctgcgctagatatctgcagaaaactcacattaatgttggccattgtgtggagggatgaggcatagctctaaataaaccaatatgctcaaggaataaggtgtcgtatgtgaagttatttcttttaaaataacatgaaaaactaaagtaataaaatgttaaaaataaaagaaataactttaccaatggtcctaaaccattccaaaaagtgaactactatttaccgttttctctcaaatttctgtccacgtgaattaataaatttggcataattttaatcatagtacagaacagcatttttatatatatcaagtccttcacttttgttgacatattgtttcaatttattatattgaagatctgcataatattcaagtaattagatgtgctcaataatttaattaataccatattgtggaattacattcttcataacatttttatgtaatataatattgcataaacgtcttgaagaatatacctggttccttttttttgccatgcaagtagaattattgggcaaaatagcatgcacattttctacttcttggcaataatatttaataatatatcacagtatattttggttctagcaatgtatgggtatattggtttgacaaccttgctagagatgcatattatctatatttttgaagttgtgctaaatggacatgtataaaatcttcttgataacatggttgactcctccaaatccagtatttattatttcaaattatgttattcaaaattttgcttaattagctcattggggaaaaccaaatattttaaatcattcaggtgctttcaagacctggggtttattattaaattactaaatgccaataatttttatatgactccatgtggaaatttggaagatatacaagatgtttctgaaggtgtatcgatgcccttttttgaccagtacttaacatgaacttaccgtgtactgtgtgattatttctctttttgaaagggaaccagagggtgcaaactctttatttgagggccctggtgtctcaaggttatactccagaaaatctcattctttcctttcccaactggcatttcaaagatatttcaagtactcatattaccagatattaagcacttcagcaagaaattatctaaatttcccaatttgctccttaaagacttcttgcagactctttttcaaatttgcctgtggagtgcagattttcttgtgcacaacactgaatttatttaggtagtagaaaccttcctaggtgatcctggttctctcaaaatgtgacagataagaaggccagttcataacagggcaaggtagatttttctggaaagtaacttgcagaaaaatgaaaggctaaaggtctaattagagatagaaattgttttttaacatattagttagtggtaaaaaaaataagtgaatgctttttcatgtccataacgctgcagggacacccttgaacatgtctctttataatatttctccaaagtatgtatctggaaatgacattaatggatggtaggaaatggacatcttcaaagttttccatcattgacaatattttctccaaaattcttttaacaatttagcacctccatcaataaggcatagaaatttctacttccttacattttcaagaaccctttgttatcagattttaattcctgtctaaaacttgtaaaagggtagggagtaattgttttaatgtgcattctctaatcactaatgaaatagagcagtttaacaacaacaaaaagaaaggaaagccctaatggccaatagaaagaataacttctgatgtttgatagaacagtggggtgcctacagttcataataatttattgaatatttcaaaatagcagaagaaaagatttgaaacattaccaacacaaaaaataataaatgtttgaggtgatgaataacctaaatgccatgatttgatcattatgctttatatgcatgtatcaaaatatcacatgtgccctataaatatgtgcaattattatgtatcaattttaaaaagattcgccagctgaagtcatctcactacaaatcaactgcaccaaatggtcattcaaccaacacagccccactcctcaagattttagatgacatttgtctttaaataatgaagatcgccctgcagggattattggattatctgttaccatgcaatgtcttagttactatttagtactttattaaaggttagttgaggataaggtaatatgctgaatggtttgggatgggacactacctggaagaaaggaaaggatattgattttaactagatagtatgtatcttacaaatggaattatattttacaataatagaagtggagtagtagttatttatgtaacacctacaattagacactatgctacagatttttgtatacagttgacccttgaacaacatgaaattaggggcactggccccacatacagttgaaaacccacatgcaatttttgaatccctaaaacttaactgctaataccctactgttgacctgaagccttactgatagcataaatagttgactaacatattttatatgttatatatattatatactgtactcttacaataagagagagagagagagagagagagagagagagagagagagagagagagagagagagagagagagattttagtttggagaaagaaaggccatggttacttttactatttatcctaaaaagaaattattgaaggacaagtgtaaaatgttgtcacgtgtaagggactaaatttagcctctccgatgtcagctagtggaagtgagtggaaggtacggatgcagacaacattgaaagagatcacattctaggaatgcaatgttacagcccaattagttcatgagaaagcatggttggaagatatattgtttctatttgtatgctatagaattctgaacggtaaacttaacatgatcagggaataagttattcctcacattttctgcatcctctgggagaggataacaaaggaagctgaggaagtctgttctggaggcaccatgacaaagcaccagacagaaagcagtcacgtgtggggagatgagcagagacaccacttctcaagcacctgattattctttctcagtatttagaagcaaaaattatccttaagaaaaacaaccgcaaacgcaacacaggctacacagatgagaaaatggggcttgcagagctcaaaccattacaccattcagaagctggctttggtattacttcaagttattcaaaacagtcaccacttgctgagcctctgatgtctcatctgttgaatggatttcaagagagaaggctgaaaaggaaggtgactggaatattaagaactgtgagatattctgaggaaactctaatttgtaaattggtagaaatgccagtaatttgttgggaattgaagaccctctgtattcaagagcgaagcttggcagctgtgcactgttgttttataaatcaatattacatctgaaagtggtgtttgaatgtttgtgtcatt

SEQ ID NO: 464104 - DNA, 2392 bp, Homo sapiens
gcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacgggctcctagagagggcggggagacgaagcaaggccaagttccaaagggaggataggcccagctggcttcagcgtccacacggcatagtccttcatgaatgttgatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggctacaaaagtgtttacttttcagatatatcagtggtatatgtgaccttcaccttgccagtgggggctatgatgagacaccttaaggagcgtgtgaggtggtcatgaggatgggcataatgaccctgcagggcctagtcaaggatgggtcatctgaggttttcttctgctaactttcatcatgacccaaagaaggtccagggaaacggatgttatgggaggatcttgctgctaaggaggaccttgtaggacgcttagaggttcccagggtggtggaacccctgaagtgttatacttccgggaggaagtggtgggggacaagtgggagtgacagctcagatttggactcc

SEQ ID NO: 464105 - DNA, 2169 bp, Homo sapiens
ccggggcagaggaaaggtgtcacccaggcaggttcagggctttctggctataaaagggagcctctgggatcagcaggtcatatctggtgcccatggttgactgaggagtcggatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggctacaaaagtgtttacttttcagatatatcagtggtatatgtgaccttcaccttgccagtgggggctatgatgagacaccttaaggagcgtgtgaggtggtcatgaggatgggcataatgaccctgcagggcctagtcaaggatgggtcatctgaggttttcttctgctaactttcatcatgacccaaagaaggtccagggaaacggatgttatgggaggatcttgctgctaaggaggaccttgtaggacgcttagaggttcccagggtggtggaacccctgaagtgttatacttccgggaggaagtggtgggggacaagtgggagtgacagctcagatttggactcc

SEQ ID NO: 464106 - DNA, 2502 bp, Homo sapiens
ccggggcagaggaaaggtgtcacccaggcaggttcagggctttctggctataaaagggagcctctgggatcagcaggtcatatctggtgcccatggttgactgaggagtcgggtgaggccaccctaccacaagggtccccctccccatcctacacaggaatgaaaacagtcccatgtacactttctggaagcctaaataccacccacaccatgtggaaggaaagcaggagagagactgagtggcacatcctttcgccctcttttctctcgaacctcctcccaggccgaccacccttgctgtgtccaagccaagctctgtgggctttctgttcctcctgagtagctgattttcagaatttggggtaccagggctctggggaatgtgagctagagagcagataagtctggaagatgaccactgactcctactctcctacttctccagatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggctacaaaagtgtttacttttcagatatatcagtggtatatgtgaccttcaccttgccagtgggggctatgatgagacaccttaaggagcgtgtgaggtggtcatgaggatgggcataatgaccctgcagggcctagtcaaggatgggtcatctgaggttttcttctgctaactttcatcatgacccaaagaaggtccagggaaacggatgttatgggaggatcttgctgctaaggaggaccttgtaggacgcttagaggttcccagggtggtggaacccctgaagtgttatacttccgggaggaagtggtgggggacaagtgggagtgacagctcagatttggactcc

SEQ ID NO: 464107 - DNA, 1694 bp, Homo sapiens
cagcgaaccttcagagggtgaagggaaaatttctcctaggccctgacacaaccataactactgcagtctgaaacaggtatgctccacagcctacaacagcagcctgatctggaacaaaggagacaggaatcagggcagcctctgacagagtgctcacaggagaaagagatggtgctgcccggtacagcccctcccagcattcacaggcaatggctggaggtaagaagcaccaggttaacaacgggactttctccagtcaagtacaagtcccagttctcttatcaaagagaactcaacttggatttatatgaagatcaaagaagccagctctatcaagaagcaattagcatcaacattcacagaacagtttgtgagcaacttgcaggaagatcccagagatggctgcagggcacagataagaaatgccacatcactagtgctctccatggcacagagaaatacttatggaaaaacatggactttgatgattcacaattgaaaagtgactcagaagagctggactttgtaggagaaaaacattgaaaataatctaaccaattatttcacttatttttcattttcatgtatgcacaaaatgcatgtttaaataaccctaaaaaactctttcaattgagaaaccctgactgtcaacgatagaacgggtcaagacttccatgtattatgaatatggcagacaaaataaaattcttagtttcataacggaaataaaggagaaatgtgatgttccgggaaagcagctgagacacattctaacagtatagcttatttgcaatacattgggtatttactcaaccagtgtttactaggcatcaaacaaactcaaaatacttgttagaaaaaaagacaatacctaagatgttttcacagattcactaatcaccaacatttctttgaatgtaaaaaatcttataaaggttgtttgcagaaattaaattagtaatttcccaaatttgacatgctatttgattctgttagcagataatacaactaacttttttttgttcgtacgttttcatggttacagagctggagaaagaaacgttatgtatgagaaaatactttggtttaaattgtttacgagtaatttctctcatactgatgtgctaaatggcttctctttgtccctccaggtcactctccatcttttccgccagtgcccaactgactgatctttacagatggtgtcaacagatgcatctaccctctggcttcaagttgagttggccaatgaagggaggcgctgcggaaagtacatgacatttgcagttgtgggcgactgtgctgtgggatgaaaccaggctcctcatcaagatgaacatagattcaagtctccatcttagccatttcctagttctgtgattataaataaactccttgacttttctgagccttagtttcatgatctctgtaatgagaataatattatctcttcccaagcatttgataataattaaccatttctaaattggggataacatcaataccgtaaggattagctaagcatatcttccctgtgaaatgtatgtgcctctaaaaactcaatgcattgatatacctaccctattgaaatggataatttcattaatagtaagttagagaatgctgattaaatgaagaaaacacatgaatatatttaaagtgatgatatcttcactttttatggtataattata

SEQ ID NO: 464108 - DNA, 5065 bp, Homo sapiens
tcgtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggcccacccctcggtccttcctgggtgtccgtctcccacactgccacagccagcactctcctccccaccgggaccccgcaagctctccagccagcctgggtgttttcttctgggagttggaccgagttcccggaaggggtcggaggctgtgtggtggcgtctgctctcgcctgacctgtggcggcttctccgcccctcgtacccctggggaggcacggaggactcggctggaaagggtgactccgatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaactatagaatttacgtatgttacatttttaagtatgagttaaattgatataaagtgttcctcaatatttaataatgtaagctgttgtcatgacagtattttttaaaaataataacgtatattatagttacgaaacacttgtgccagattagaacatcaagcacagaagcagctgtatgatttacctgtttttttgaaactttaatgtttaccttcccctatgtttaatttttctgtggtgaacacttttgttagaacatggcttttttatttttcttggaaaaatatgctat

SEQ ID NO: 464109 - DNA, 969 bp, Homo sapiens
tgttccagccatataccctcggttctttccaagacatcgctgaatcaaaatccaaagcaggtattcccaaggtcagacacttctatgcaaactccacaccttattgatgctacctgcctcttcatgtgtactgctatttataaccaccttgttacaaacaccttacttagttcaggccttgtcatttcagccttcactgtctctactgctattggagacatggctctggcaattaccaaaacattgtttcaagacataggcacaggcaaatgtttcgtgatgaagatgccaaaagcaattgcaacaaaagcaaaaattgacaaatgggatctaattaaagaacttctggaggagccaagatggccgaataggaacagctccggtctacagctcccagcgtgagcgacgcagaagacggtgatttctgcatttccatctgaggtggaatgactgtggctctgtgccatctcgaaatctactggtctctaagcacaaacgaacattctcttaaactaatgaaatgagtggcaggcagcgtgtgcagagcaccagcaaaggctcagagggatgcccacagagttccaccgcaaccgtgcacagaggaggaggagaatgctccctacaggtgaaaactaggctaatacacaatgattgaagactaaaggatgagaagagccaccagtggggcgcattcacagagaaacggtcacatgatgaggcagcaagaaggcaaaaattgcgagccaacaagagaggcctcagaagaatccaaccctggtgccgccttcattttaaacttccaacaaccccagaactgtggaaaaaaattctattttttgtctgtggtattttgttatggcaaccctagcaaactaatacactgagcaaactaatacattaaacagaatattaaaacgaaaaaaacatactgttatttttagtatgtgctatagtctgtatctatttatt

SEQ ID NO: 464110 - DNA, 1681 bp, Homo sapiens
attaatcaatcttaatgggtcaaacaaaaggcgggagggtttctgcagagagatccgctgttagtctgatgggtttccctttggacccacttgaggaggcagtctgtcccttcacagagctcaagcgctgtgctaggagttccactgctctcttcagagctggcaggcaggaacatttaagtcagctgaagctgtacccacagccgccccttcccccaggtgctctgtccgagggagatgggagttttatctataagcccctgactgggactgctgcctttctttcagagatgcccttcccagagaggaggaatctagagaaaaagggagtgggcccatctgtgcacttccttgtaaaatccagctttagcaaagggacctgcttacatctagagggaggaaaattgcatgatctccaggggagaagcccgctggcctatgtgcaggttttcatgctgtcctctgaaaaccacctggttccttgtttctactgactcactgagtgtgagagaatgcatcattgactttttcctctattccctcttttcacatgtaaaatgtagatttactgaggctaataagagcctcacaagaatgtgaccacctgcctcactgcctgcctccttttcttccccctgctgcttgcagttccccttttgtgaactgaagttcacaaaaccccctttggaaaaaacataaatcacaggagcatctgtaatttatgctttttcccaggcgcatcctcagctttggccaaataaacctctaatggatggagacttgcttcagtcactttttggtttacattttggtaaccacaaaggggctttctgagtggagttggctcttggcctgtagcaactctcctactggggccctagtaccagctggagctctttattgctctgacctattggatgatttgctgaagtctgagagtttctccctccagagatccctaatcactcaaaaatttccagttgagatctgaagtttattccactgcagaactccttttctgagagttcttacttctaacaaggaagaagactttcctgcttccgtgatggcagagagcagttttcagcttgtgccccatctccagggtgaaagatatctccttcaaagcttttcaggggcccaactggaaaatcttaatgttaatttaaggtcaaaagacataatttagaatttgttttggacaggcacatagaccaatggaacagactagagaactcagaaataaaatcacacctctacaaccatctgatcttcaacaaagttgacaaaaacaagcaatggggaagtgattctctatttaacaagtggtgctgtgagaactggctagccatatgcaaaaattgaaactggaccccttccttacaccgtatacaaaaattaactcaagatggattaaagacttaaatgtaaaacccgaaattataaaaaccctagaagaaaatctaggcaataccattcaggacacagacgtgggcaaagattttacgatgaaattgccaaaaacaaaagcaatggcaacaaaagcaaaaattgacaaatgggatttaattaaactaaagagcttctgcacagcgaaagaaactatcatcagagcaaacaggcagaagaaggtggaaggagctgacttgctgagtcttcccaccttcatctttctcttgtg

SEQ ID NO: 464111 - DNA, 1817 bp, Homo sapiens
attaatcaatcttaatgggtcaaacaaaaggcgggagggtttctgcagagagatccgctgttagtctgatgggtttccctttggacccacttgaggaggcagtctgtcccttcacagagctcaagcgctgtgctaggagttccactgctctcttcagagctggcaggcaggaacatttaagtcagctgaagctgtacccacagccgccccttcccccaggtgctctgtccgagggagatgggagttttatctataagcccctgactgggactgctgcctttctttcagagatgcccttcccagagaggaggaatctagagaaaaagggagtgggcccatctgtgcacttccttgtaaaatccagctttagcaaagggacctgcttacatctagagggaggaaaattgcatgatctccaggggagaagcccgctggcctatgtgcaggttttcatgctgtcctctgaaaaccacctggttccttgtttctactgactcactgagtgtgagagaatgcatcattgactttttcctctattccctcttttcacatgtaaaatgtagatttactgaggctaataagagcctcacaagaatgtgaccacctgcctcactgcctgcctccttttcttccccctgctgcttgcagttccccttttgtgaactgaagttcacaaaaccccctttggaaaaaacataaatcacaggagcatctgtaatttatgctttttcccaggcgcatcctcagctttggccaaataaacctctaatggatggagacttgcttcagtcactttttggtttacattttggtaaccacaaaggggctttctgagtggagttggctcttggcctgtagcaactctcctactggggccctagtaccagctggagctctttattgctctgacctattggatgatttgctgaagtctgagagtttctccctccagagatccctaatcactcaaaaatttccagttgagatctgaagtttattccactgcagaactccttttctgagagttcttacttctaacaaggaagaagactttcctgcttccgtgatggcagagagcagttttcagcttgtgccccatctccagaatacagaatctaaaggggtatcagccagcctccctaacacagagatacagaatgtctgaggtattgcctttgtctccaagaagaatggctggagcagtagctaccactttgtgaccaagaaggaaaggctgagagaatcacagagaccttaactctggtgtcattgaactacccgctttcagactcctcactatgtgagaaaaatgactccccaatttgcctgagcctctgtttcttaggtttctaaatagacagccaaatgtaattctgaatcaatacaaataaaaatgttaaaacctctcagaggtattcattgttgatgagttgttatatattcttccagacttttaacactttacatttatgtgcaatattataaaaagtaagatttttttagtatcataaaaataaagattccttaaatctttaagaataagagctaatgtctttaaaaataaggttctacactgtagaatttggtgtgaatgtgaaagtcaagctttatttaaatgacaaatgtcttgaaaatccacatgaagctaagtgtcttttgtggatcacacattattggatgtctgtagaactttttaaagggtctgtaggagggggaaaataattttctcttctgcccttcatgagttcttagctggaactccatttaacaaaagacagattaacaagagaaaagcaaacaaaagtttaataatgtgt

SEQ ID NO: 464112 - DNA, 877 bp, Homo sapiens
gacgcggcgggcggctccgggaggcgacgggacccccaggccggcagccgagtgaagaggcaggaactgtctacaaatgctccggctccgaagccccgagggaaagagcatctttcacggagcaccaggaattgacgacggtggaatttgctcagatcccctgaggccggttctttgagtttctgtctggccctccgggagaaccgtcccaaagttaactttgaaaacactcacaggagagggaaggctgtggggtccttcgcttctcaaaccccagatgcccccggaaagaacaccgcccccgaccaccaccacaaccagatgtttttaaaaagagatgctaagcaaaaggcctgattatgaggaatgagccaaagtcatgcaaggcgtggggcgctatgggactgcgcagtgacgacccagtgaagtagatgccttgacgattcccatttcacggatgagacgactccggcacagagaagtcagagggcctgtcctgggtcacacagccacaggcggcccccagaacgggacttcagggtgcaccactgcaccccagcagagacctccgcctggcacacagggaatgctggagcaatacttaaatagcatggcagcttttcgtgtttggaagccttcagaatcatttcctaccctctcaaggaacccattctttagaggtacacaccgttcctgtcagagaggctatcttcctagtgctaaatgattttttgatgcactgaaaattaaattcacactcaaatttctgcatttgaggagattttcctgtacgctgagctctgtcaaaagaggtatattgaagagagggtagttctgggaccatttgcaagacagcgcattgattggaagcctatac

SEQ ID NO: 464113 - DNA, 749 bp, Homo sapiens
gacgcggcgggcggctccgggaggcgacgggacccccaggccggcagccgagtgaagaggcaggaactgtctacaaatgctccggctccgaagccccgagggaaagagcatctttcacggagcaccaggaattgacgacggtggaatttgctcagatcccctgaggccggttctttgagtttctgtctggccctccgggagaaccgtcccaaagttaactttgaaaacactcacaggagagggaaggctgtggggtccttcgcttctcaaaccccagatgcccccggaaagaacaccgcccccgaccaccaccacaaccagatgtttttaaaaagagatgctaagcaaaaggcctgattatgaggaatgagccaaagtcatgcaaggcgtggggcgctatgggactgcgcagtgacgacccagtgaagtagatgccttgacgattcccatttcacggatgagacgactccggcacagagaagtcagagggcctgtcctgggtcacacagccacaggcggcccccagaacgggacttcagggtgcaccactgcaccccagcagagacctccgcctggcacacagggaatgctggagcaatacttaaataggggaggtcagaaatctcacgggctctgctggcttctgtgcttcgtctctcaaggccaaaatcaagatgtcatcagtgctgagctctggtgcaggatccacgtccaggctcactggggctgctggcagaattcagctgtgt

SEQ ID NO: 464114 - DNA, 1539 bp, Homo sapiens
gacgcggcgggcggctccgggaggcgacgggacccccaggccggcagccgagtgaagaggcaggaactgtctacaaatgctccggctccgaagccccgagggaaagagcatctttcacggagcaccaggaattgacgacggtggaatttgctcagatcccctgaggccggttctttgagtttctgtctggccctccgggagaaccgtcccaaagttaactttgaaaacactcacaggagagggaaggctgtggggtccttcgcttctcaaaccccagatgcccccggaaagaacaccgcccccgaccaccaccacaaccagatgtttttaaaaagagatgctaagcaaaaggcctgattatgaggaatgagccaaagtcatgcaaggcgtggggcgctatgggactgcgcagtgacgacccagtgaagtagatgccttgacgattcccatttcacggatgagacgactccggcacagagaagtcagagggcctgtcctgggtcacacagccacaggcggcccccagaacgggacttcagggtgcaccactgcaccccagcagagacctccgcctggcacacagggaatgctggagcaatacttaaataggaacatacagtggcataagagagaccaacttggtgataactgatcataggattagaccaaggtgcagaagcaaacagaacctccataaaatgtaatgatgtcttgtgcctgcaatcctagtgctttcagaggccaaggtgggaagattccttgagctcaggagttcgagaccagcctgaacaacacaacaagacctcgtatctatgaaaaaataaaaataataaaattagctgcacacctatttggtggcacacacctgtggtcccaggtactcgggaggctgagatgagatcatttgagcccaggagatcaaggctgcaatcagctgtgatcatgccactgccctccagcctggacaactgagcgagaccctgtctccaaaaaaagtaaaattaaaaaaaaaattaaaatgtgatggagtgcagaggaaagttagtggcttcatcctcaggcatgtctgtccctccttctgcaggagcacacagcacgctgcactgtggggaccgctgtcctttggtctgcatgctgctcatcgcatctgggggagaggacccgatatcgtttgtttttacgtccgcgaacttcacatggtgttaccatgactctccttcctgcagccaagtgaaggacaagtttgcttccccttccacaatgattgacttgggctgtagagggaaattcttctatgtccctgatgtgctcagcctagaacagctgagcttgaaatggttaacgccacccccaccactccttaagaaagtctttcaattctgcaatgaccattatctgcaaactctagaattatctagttcagatagatagagttaacactaaatagaagaaaattaacatatcagattacaaagtttcttgtaataaatgctttatacagacttgtaagcacttatataaattttaaatagaataaat

SEQ ID NO: 464115 - DNA, 819 bp, Homo sapiens
agcgggacatttgtcttggcgctctggggaaaaaggctggagggcaatggcgcgatcttggctcactgcaacctccgcctccctggttcaagtgattctcctgcctcagcctcctgagtagctgggataacagacatgcatcaccacgaccagataaggacactgcaacccagagaagaaacctgcaaaggccgtgttcacacactcacaagagatatggctgtgatttggatccagatgtgatgggctgacaacaaaactcctgtgataccatgaagtcttcgggaggcagaattgaagtgaacatgaagtttagcttagagaagaaaagaataaatacatacaaaacatttgatggtgaataaacagaaaatggtgtattcaacagaatttgactcagcaataaaaatgaaccaaactatggaaaacaacaccaacaacaggaagaaatctcaaaataattatggtgggtgaaagaggccagaccaaaaaaaaaaaaaaaaaaagactagaaaatgttaactacccaatagtgttgaaaaacaagcagatcagggattgcctagggaagtggagggaagggcacccttgaaaagaggtaggaaggaagggatgataaacaggcagaagggaaacttttgaggggtgggggatatattcactaccttgatggagatgcttgcaagggtgtcaaaatgcatcacatcgtatgctttaaacatgcacagtttatcgtatgttaattatagttcaatgaagccaaaaaacatatttgaatttaaatatgtttagtacaatccacaaatcctatgaagtaga

SEQ ID NO: 464116 - DNA, 1102 bp, Homo sapiens
cagccagtgacatgcgggaaatgccagttgtgtggtgtcctaggagaacggtgactgtaaggtccagttgcctgagatggtccaagttgaggcctgtgtctcagcttcaaaagctgagagtgaggatggtggaggaggcatggatgtttgaggagggaggaaaaagtgtgaaacagccaccgaggagtgtggcagtccattcactcgaatggactgggaaaaatggagaaggattccagggcagcaacgaaagccccctgagttgcaggggcagagtaggaggagagttggagtcaagcggggatggagttttgccaagctggagggcaatggcgcgatcttggctcactgcaacctccgcctccctggttcaagtgattctcctgcctcagcctcctgagtagctgggataacagacatgcatcaccacgaccagataaggacactgcaacccagagaagaaacctgcaaaggccgtgttcacacactcacaagagatatggctgtgatttggatccagatgtgatgggctgacaacaaaactcctgtgataccatgaagtcttcgggaggcagaattgaagtgaacatgaagtttagcttagagaagaaaagaataaatacatacaaaacatttgatggtgaataaacagaaaatggtgtattcaacagaatttgactcagcaataaaaatgaaccaaactatggaaaacaacaccaacaacaggaagaaatctcaaaataattatggtgggtgaaagaggccagaccaaaaaaaaaaaaaaaaaaagactagaaaatgttaactacccaatagtgttgaaaaacaagcagatcagggattgcctagggaagtggagggaagggcacccttgaaaagaggtaggaaggaagggatgataaacaggcagaagggaaacttttgaggggtgggggatatattcactaccttgatggagatgcttgcaagggtgtcaaaatgcatcacatcgtatgctttaaacatgcacagtttatcgtatgttaattatagttcaatgaagccaaaaaacatatttgaatttaaatatgtttagtacaatccacaaatcctatgaagtaga

SEQ ID NO: 464117 - DNA, 1011 bp, Homo sapiens
gagaccaatgaggtcagtctctctgggacccagattggagaccttggctctaggaagttcctgcggttccaacaagagcacctgagcctcagcttgatcaagtctgacaagtttcggaagtagcaggagaagggtgtggggctgcggggaagagatggcctgtagctgattcttctccctctcacgttcccttccacttcttctcctcttccagcccacccaggaagtggcctccagcctccctcgtggtctgagaccatttggcatttgggataaggatttctatgtggcccctatcccagatggtgtcttgtaagcacggcacgtcatgggtgcttagcaaacatttgtcgaacagattcttgaaagactcctccatccgttgctttcaggcagatgagattgcctggattgattttgcaggacttgaaagaacatccacaatgggccccagtgtcacccaccccagcagagagaaatgtaactgccaaagggaccggatacacgtgtcctccagccaacacgtcagctccctgcaggcacactccgcagaaagccaagttcaaatcaaaatggtgcttggcttgcttctcccaggcaggctgcctgatggttcctggatatgccgtgtgtgtccacacctctgggcctctgctcagtgtagagatggcatacaggaactgaatggatgagcaggtcactgagcagacacgctggggaaagcaccacgtggagggaatcaagagagctggattctcattccagtcttctggctcctcaggaaataacacaatagagacaaagctgaagtccctttatctactacccaagtcccacagataactaatgaatttggtgtatatccttctcattattttccaatattttaacatacctatccatatatttagcatttgatattgatttatgtcttaatttacataaatggtatcatatgattcacattggtgtacatcttgcctttatcaacaaatgttatgtttttgaaat

SEQ ID NO: 464118 - DNA, 3171 bp, Homo sapiens
agcctgcagcggtcaggcagtggagagtgaccacataggaggagaaagccatgcctgtccctggagacctctgagagctcacaggagggaaagagtccgagggtggagctgatagccactcagaggtcccttgccagatgctagatggcaacagtgggttgagttctgagaagatcagccagaaggccctggagccgtgcggtgtcacaaagcagcagcgtgagccgcatgcggctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccacccggcgtactcgggcgctcattggctacgtctgtcgcagcgctgcgctccaacgttccgacgccggcggccgtgccacgtacgcggcagccgattggcccgcggtggtcgcgtcactgcccgcgccgggtccggcctgagttcggggccagcagccgtctacccggtgtcgcgttctgtgttgtggcggccctggatccggcgtcagggcgaccgggcggacgaggtggagccagagtctgtcaggcgggttgtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtaagcctgtgggctgggctgggtggggagaggggcggggagtgtgcctgcctccctgacaaggcctatcctctcctggaggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgt

SEQ ID NO: 464119 - DNA, 1424 bp, Homo sapiens
agcgctgcaaacaagggaggagtggaggaaactctcaagggcctctgaggctctggctgctctgtggaagacccgaaaacgagtggggaagaggcaagctgatggcaaaagaggaagttagagagatgctcttgagaagaactctgtggggcattgctgatttgcagatggaggggcagcctctagaagcagagagtggcccctggctgactgctggcaaggctgggtggaagaatgaatgcttgcctcctaaaggcggggatgaaaggggcggagatcaatgtgctccacagcatctaacacgatgtaaaagaagatgcaccagtgtgatggggctctatgtcactaaaggggttcagccttctgaagaatttgagaatccatcattgcactggaaaatggaacaaaaagtcgacttcaaaggaccttgcccacaaaagacaccagaatggcatgaaaatgcacctcacagacagagcacccagctgctgtgctttgaagtcagccacacctcccattcattgctgttaccaatggactgactgaatgctgtggcgatactgaggccgtcttagtcccggaagacaggtggggctcctttgtccaccgcttaggctggagtacttccccatggctttgacaaacaatccttagactgcagagtagtgtaggattcttccattcaaccttctctccctcatcctggggtcagacttggatgcagtccgacagctgtcccagcctttcctagctccttctttatttctttttacacaggcatttcccactattaaaatcctgacatatttaatcctgtctttgtatctgtttctctgaggtcctgggctaacacaatttcccttctggaacttttatgaaaaatgagcaagtggagacattgatcttattttctaatatctgggtgatctactatttggttcttatgcattaaattagattttgaaatcttaaactcaggtccgggtctctttgagctttgctaattagtgcatggtgtggaaaagctcatgtgtcctagggaaccacttgacactttgatgctccatggcatcaaagcatgaagaatgaaataaaatggtataattattttgtattttaactataagatctcaaaggatgttatagttaaaattcaaagtaattatactatttacatgatataactatataccatataaggtataaaggctctctgtgatcctttaattctccaggatctcagagaaacagatgcaaagacaggattaataaatataaataaatttatataataaaaatattaaagatagggtcaaaagcctccaatttttaactgatagagttgaccaaagtatattaaaataatatacttaattacttaatttagtcagcatgttattgtttgcactagtcacaagggcttt

SEQ ID NO: 464120 - DNA, 751 bp, Homo sapiens
agcagtccacgccttgtggcggctttgcggagctgctgctttggcgggagttggaagctggtgtgaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcagtaaggcccgccctccattgggttggggatggtgggagcagaagagcagaggctgggccaagcccttaagtcaggagcagtccccatctggtc

SEQ ID NO: 464121 - DNA, 1611 bp, Homo sapiens
agcagtccacgccttgtggcggctttgcggagctgctgctttggcgggagttggaagctggtgtgaggtgagaggcgcggtggtcgctccccggcgaggccaggtttctgtggggagaaggagagtgccagaggtgactggttcatggttcttctaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcaggcttgccgcttgtcctcctctctactcacaaaaccctcctggatgggatcctgctgccctttatgctgctctcccagggcctgggtgtgcttcgtgtggcctgggactcccgcgcctgctcccctgccctcaggctctgccctatgtcccacagagctctgctgaggaagcttggggggcttttcctgcccccagaggccagcctctccctggacagctctgaggggctccttgccagggctgtggtccaggcggtcatagagcagctgctggttagtgggcagcccctgctcatcttcctggaggaacctcctggggctctggggccacggctgtcagccctgggccaggcttgggtggggtttgtggtgcaggcagtccaggtgggcatcgtcccagatgctctgctggtaccagtggccgtcacctatgacctggcctcggcccccctggggctgtggacaggagctctggctgtcctacgtagcttgtggagccgctggggctgcagccaccggatctgctcccgggtgcacctagctcagcccttttccctgcagctttgcctacttccagtgggctgtgtgcaagtttcctggtgggcccgagcaggccacctaagagccttctcttgggcaggaatacatcgtcagtgccagaagctgctggggcggcagacagaccctggagcagctactgcagcccatcgtgctgggccaatggtaggggcacaggagcgtggggtctcagggggcaaggcaagcagcccttcagcaccagcttatgtatcccccatatacacacactagcagccctccctcaccaagtatcctggggtcatctagaatagttccaggtactc

SEQ ID NO: 464122 - DNA, 1014 bp, Homo sapiens
cctccatttcctattctgcaaagttagaatcttagtagctcctcgaatatgggggattgtaagggtagagtggctgatgtagatattttattttttattcattttattttttttatttttattttttggagacagactctcgctctatcacaccactgcactgtaccctgggcgtcagagcaagactccatctcaaaaaaaaaagaaaaaaacatcctgcatcccttgttcctttgtgttcccctagacaagcctctgggctggctttgcctatctcatgcatgcaggcagtcatcctcctttggccagtgcatacctgactcctactcagtgccaggcctggagaagactgtgagacctgcccttgaggagttctgtttgcaggaagagagtgataggcacacaaattatttccaataaactacagaaaatgtcaccagaatctctattgtgatcatgtcccccacccatatctcacagtaccctatcaggctaccccctttaggcggtgccctcaggagctctctggctggaggaaggagagacagagaggccctgcaagcgctgagctctatctataccgtgtgcaggtcccgcgctggctccgcggggcacggggcctggaggcaggcaaacgctaaggcgagggaggagaagggcactggcgaatcacaggctccccagttgcagctacactcgccccgatgccctcagggactgtgcggcagtggtggagagaagacaagtctagttacaccaccagctagcggccgcgctcggactggctccccgcggttgggctactcgcgggcttcgccccgcccgcccgccggccccacggccttagccctgcccacagccccgctcggccccgcgctgccggagattttcgtccgctcccgagcggcctcagctcgacccacggccggcctccggaggctagcgctttccgggagctggcggcgttattagccccgcccacagcccgactcttcagccccgcccaccgctggc

SEQ ID NO: 464123 - DNA, 1950 bp, Homo sapiens
cggggataggggctcagaaaagttcctgagccaatgatgtggacctaaggtctgaaggatgaataaaagtttactgggtgaagaggggagggaagagtgttcctggcagagggaccagcatgtgtccaggatctcttggcatacatttacctcagccgcactcttcagtgctctgcatccaggctacgcggaggctgcatgttacaggagccgtgcatccctgaagacttggaataagtcaagatttacataatcccagagacatccttccaaagcgtgatagtaactctgttccatggctggagtggctcctccaggtgccagcagcataaacccacctttcaatcagtctgcagctcagaaatactacctgattctagacaggcttttcaacgtaataggttgaattattatgtcttgtacataaattaagactttacatttttatactgctatttataatgtatataatgcaaatccatgtaaactatgggaaaataatatttctgcattccccgtgtctagggatgtttccttcagacatctgttttggcttcattagaagggacagagatgctgttttctatatttttgcattgccagagctcagcacagtgacatatggtagaaatgcaataaaaaaagagatatctgaggctgtgttccatggtgagcaggtctatgcaaacctacccccaaaggccaaggaagatgaaagaccaaagaaagaagctgacaaatccaatttcttagaaaaaaaatatttaacagagatttatgaacagaagcatgttttgggcagccataagacaagatggtggatccccgcactgaagggcgtgaccttaaaggggcttgtgcctttctttgccccttccgccttccggatggatgaaagcagaagcagtggctggagctagagcagctatttaggactatgagatggaagaaatgtggtgacaatagcagaacaaaaatatagaaatcttgggtacttgatgaccacggagccgccatacaaactctggactataatttccagagactgtttatagaatgaagatactgtcattacctctgcaaagaatgcatcctagcacagatcaaagatcttccaagtccagccacaccattttacagttctgaacctcgacttaggaaagcagtggatctttatacatttgacacatcccttccctctaggatctctgtggctattgaaaatggactggagaagatgagtgggagtgagaagaggataacagaatcagataaaaacctgtcatgttactaagagcaggagatgaggcagcctggaccaagatggtggcagagagaagaaaattgcttgagagaattgattaaactacttggttagcacagatagagctgaatcaaaaattaggatggtaagctaagtaattttacacacaaaaaggcagagttgcattcataattagtctctccttcagactgaatattacagacaaaatatagccattggtgttgcaatcacttcctttgggtttgtatccaaggttaagaatgtcagcatccaaagacccaaattcttaatgtttttagttgataaagtttattcaaggtagacagcctgtgttgaataacttagtcttccacaaatttcaagaaaaatccattgtccctcttctccgccacagacacactttagttgaacattaagcatatttattaaagaaacattctccttgtgctttttctcccaagatggatggtgttcttacttagagttataagtgtcagaataaaaatgcccatgaggttgaattgtatgatgttatagtaaagtgagataaacattctcagaaacatgattgtgacttaaaaaaaaaaaaaaccaacaaaccactttctgtagaggaattatgctttggggacagaaactttcctttataatttttacagctgcac

SEQ ID NO: 464124 - DNA, 1007 bp, Homo sapiens
tccaccacacgtggggtgtggttctatgtgtgagagttttgctgcctcttccttcagcagcgtccagaagccgtcgtctctgctgcggcctgagacacagtctcacagctgctcgggcctcgagggcctaaggagacaaagtgagcagagggaaatgccacattcaacttatgcttcagtgtcggattccattggaaagggggcggtgactggaagtgaggacaccaacccatcaggcgtgctctctaacagtctaataagtcatgccttgcacaactggcttctgcttcgggatgagccattggctgatgaggcatgggaggctcagcaggtctgttcccttggcatgtgggacatcttgcagtggatgcagggagggaccatgcctctagcattctctgggaagaataaaggagaagtttatcttcccacctacctcccattgcctgtttttcattggtcaaaacttgtcccactaggaattaactccttcacatttccaagtttatatcatatgactgctccaactacatgggaccccaaaccccaaacctgatgtatgtatagtgttcctgtttcatccaagcctggaaatgaggggaagagccagaacctctaggcttggtgctctggaaaaagaattagaattgcattcaaatagtcaggcttcaagttgcttctgcctctgtgtgaagcaaatagtaacaactcacttcgaaactcaggctcctggactgtaaatgaggataatgatactcaccctaccaacctcagggactgttctaagagcaaaatgaaatgagactgagctctgaaaatgcttaaatgcttttcaaagtagagtgatcgtgctttctgtagcatcaaaacagtcctctataaatgggcaaagtcaaggcatggactggatctgacaacagagaatggcttgagggctggaaaaagaaaaaaatgcaaatgccccaaatctctgcttcccttacagtgtggaaatcgccccataacac

SEQ ID NO: 464125 - DNA, 739 bp, Homo sapiens
gtgccaccaccagtctccaccactattctgaggcagaatgcacctattggctcacaatgctgtgaaagaaaacaagaaagtcgtgatgataacaatgcagtgtcttcattcataatggattgcagttccccactcaggaagaggacattttttttaaaactacatgatacaactgagagcttggaagctatccatgcataagttttaaaacccagcagcttcatggtttcctccttctgttggcctggccagtggacacagtggtcacgttcctggcatggagatgtcattcatggtctctcagacccaagtgttaccagtgaagggtgtccaggttcttggcgctttgaacaaagaattggacaaaactcacaaacaaagcaagaaaagaaagaagcaacaaaagcagagatgtattgaaaatgaaaacacactccacagggtgggagcaggccgagcaagcagctcaagggcccagttacagaactttctggggtttaaataccctttagaagtttccattggttacttggttctcaagaacacctgcagactaacacctggtgttctctgtaacaggtgtatgctagagatagcaatggtaaaagaattatatgatgttagcctacattataatttgcagactgtctcttctgccaagtgggtcagttgcgatggagaccacaattttagcagatgtgtattaatgattaagggaagcataacaatttaagagtat

SEQ ID NO: 464126 - DNA, 1207 bp, Homo sapiens
atttcctgaaaacctacttcacttgctaaaggcacatgcactggtggcaggggctggctgcaggcaaatacatgatggtgagggctgctgccagtggcaagggttggtccaagtgcagtgcatgcgtggctgtgcgggccagatgcatgtgcatgcgaagctttggaggctggggctggcatcatgcacacatgcagctgcaggggttggcggtgggcacacatgcagaagtgggggcagctctggcagggaaaaacatcttcctaaatctatattggagaggcagagagactgaagaaatgggcagagaagttacagggatgagaagaaaatggctggaccagaaagggccaatccagccagcaatgaggactgtctcagaggaggaccactgtgagaggcattgtcaagcgtccaagggcttctggagagtgaggtcagtgtcctcgcacccagggactctgctagttgcctttcccattggagcccagtgaggacttcccttggccatgctacgactttgcctggactgccaaaatcacatagttatgagggtcatgattgtacacccaactagcatagtgcctgatacataatataaatgtttagtaaatagtcattctaaaatctgttcttctttgaatgtctttgctctttttaccaccgagtgtttcctccccaatagatgtgtttaatagcaaaaacaatgatttgagatgttttggtgaatgcacaatgactttcatgtttgactgatatacattatagacattcgtctaattatatttatatacatttttttgtagacacacaagtggagaagataaatagtaatttggaaccaaaactcaggacgtcccaggagaggctagattaggaattctttgatttgggatcacgaaaatgaagtatccatattttaacagaatgattagtggcagaggaatcatctaagaaaactgagaagactctgccagagtgatgggaagaaaactagatgagaaagcaccattctggaagacatgctcccatgaaccatggagagaagaggagagggaagaagttatttgtgatgtcatttgcctgtgtcatggcctgccttcccaggagaggctagattaggaattctttgatttgggatcacgaaaatgaagtatccatattttaacagaatgattagtggcagaggaatcatctaagaaaactg

SEQ ID NO: 464127 - DNA, 1406 bp, Homo sapiens
atttcctgaaaacctacttcacttgctaaaggcacatgcactggtggcaggggctggctgcaggcaaatacatgatggtgagggctgctgccagtggcaagggttggtccaagtgcagtgcatgcgtggctgtgcgggccagatgcatgtgcatgcgaagctttggaggctggggctggcatcatgcacacatgcagctgcaggggttggcggtgggcacacatgcagaagtgggggcagctctggcagggaaaaacatcttcctaaatctatattggagaggcagagagactgaagaaatgggcagagaagttacagggatgagaagaaaatggctggaccagaaagggccaatccagccagcaatgaggactgtctcagaggaggaccactgtgagaggcattgtcaagcgtccaagggcttctggagagtgaggtcagtgtcctcgcacccagggactctgctagttgcctttcccattggagcccagtgaggacttcccttggccatgctacgactttgcctggactgccaaaatcacatagttatgagggtcatgattgtacacccaactagcatagtgcctgatacataatataaatgtttagtaaatagtcattctaaaatctgttcttctttgaatgtctttgctctttttaccaccgagtgtttcctccccaatagatgtgtttaatagcaaaaacaatgatttgagatgttttggtgaatgcacaatgactttcatgtttgactgatatacattatagacattcgtctaattatatttatatacatttttttgtagacacacaagtggagaagataaatagtaatttggaaccaaaactcaggacgtcccaggagaggctagattaggaattctttgatttgggatcacgaaaatgaagtatccatattttaacagaatgattagtggcagaggaatcatctaagaaaactgagaagactctgccagagtgatgggaagaaaactagatgagaaagcaccattctggaagacatgctcccatgaaccatggagagaagaggagagggaagaagttatttgtgatgtcatttgcctgtgtcatggcctgccttccctagatattgtcctaatgtgagcatcacacctaaggtactgaagtagagttctggctgttccttacggacatctctggtgctagctaccaaaacccccctttcaaagtattgactgcaaataattaagtgtagtacatttgccaggaatatttgtggtttaatatatgaccacaaaggaaggtagcgttcattcactgagttaagtggtgaaggaaacattgtttttcagttattctgcatgatattcagaaattacaatgacaaccacctgttatatctaaaaatgaagctcttcttggct

SEQ ID NO: 464128 - DNA, 2126 bp, Homo sapiens
tttctctctcgctctctcctctgcttaattgctctggctaaaattttcattgctatgtttaaataaatgatcagtagatgatggttatgggcaattggctgatccatgaattgcacagaggtctggattccctgctcagccccattgggaaggccaagatgagtggcactagactgggcaggcctgactctaggaagtatgttgcagctcatgctgctgatcttggtgaaaagatgctccaactgcctggcgatctgcatgagtatggggcagagagggccctgctacatcatggtctatgtgcaggaagcgtgaagtggctcaggctgctgatccaggactggcctgtacgttggaagacgttcgatggaagtcctggcctctacccactagatgccagcagtgtctttcctcaggttatgacaatcaaaaaagtcttgagcaatttgaagaaaaaggcaaatgctccaggatggatgtgttcaaaagacctggaaagaaattcttggagggttgccctttcttcctatgacacatcacaacttctggtagaaaatcaagaaaggaaactgggcaaccatgatgattagtcataaggaaggagacaacaggcattatgaagccaacagctgcagaacaatgggaaccatgagaggctatttttgtttggtttcaacaattaattgaacctgacagtgtactctgccttctctcaatcttctcttactaaaagtggaaagtttccatgctaaaaaaaaatagttatctttttcctgcttaagaatgattaaaatgccattctgctctttcatcttcatgtgtttatctcaaaatgtacttattacaaatataaaaatattcaaacctataaaatgacaagtatctgttattgtgtttccactgctagtgctttgctgctatttaaaaggctgccatttggaatcctaaatttgagattgtaatatgttagggacctcccttggcagtaaatatggaaaagaatagccaaaggcctttagtagcagatggcttatgtggcggtctttatattttttgtgttgttttgttttgttttaattccagttggtgtcatcacaaaaataaaaattcacctaggaatgatttggttacctcctaatttttttctagtattttccaaactgctccaaagtgaaagcagatggaaattttacactatcaaatcagaaaataaaattgtgaaacttttgaaaaagctgttgccaacttattgggtcttggagaagctggttatgggtttggcagtatcttcccaaacaacagtggttctttggagcttgtggttctgaacagtgagtggttcttctgacttaaggggatttagtacattttcttaagcatagacactcctttgagctgaaagtttcaaatatccaagacagccttcaaataaatggatgcaggtaccctagaaaggtaacagatgattttcatagacatctactactcattaatgccatgagaaatatgggcaaattcaggtgcattctcttaaagggactgtcgcagaattacagaaaggtagcgataaatggaaaggttttacatccttgggcaggagtcatgaaatgccagtgggagaaagacatgaacaagcaagagtgagtgtgaatacagaatagttacatgggatgaggaagatgtttgggaaaaataatagtgaacaggaggtggagatatgcaggaaaaagcccccataaactgtttctatgtcttgtgccttcatcagtgcttctctacctcttagcttctctaacatctctgagatttaaataaattttctggtcccttctcccaacccaccagtatgtatgtgtcactcacaggagttaatcatttggttcatctatttaattcacttagtatagagaattatattgcctgatgcacttgaatgtttcaccaatcttttcattacattaaagtgcatagcctatttacaaaattttcatgaggcttttaacttggcagagctcattcaaaatgtccaaattacttatttgcatcctgctctgaataaactgactagattcaattacctgatacctcactctgaatcactgtaatccaggtctctagttaatata

SEQ ID NO: 464129 - DNA, 3315 bp, Homo sapiens
cacccacaggtgtggaggggcaacccacccctacattgctcaactgagcctccaaccctgatgctttctacaacctgggaagctgaggcccggagacggaagtgaccaagcgcgactagatctaaagccttcccgacttccatttttctcagtaggcaagtggtccaagccccaccgtttccttcttggatttgagtctcaactccagccactcccctcaagtctggtctcccactctcacgcccctccagccactggcctcaaaaccaccgagcacatccacgcggccctcgccgactcccgcagggctgcctccaccccgctgcttcttgccggcgcatagcctcccagagcctccaatgaccgcccaagcgactgccctccctccctccctccctccttcgcctccccatctgtgcaattgaacattcattcattgccgcggactcgaggctgcccagtcctcttccggacagggccctgaggacaggacctggctatccggcttcgcggtgtgtcctcagtgcctggcccagagcggccaatttggcgagagcaggaatctctgtccctggttcctttagtccccagctttgctcccaagtgaccatccgcgaggcagcgtcccctccttggcatctgcggcttctaagacgctcaagggcccaagggggtgaatgaggtgtgggcgactaactgtagccctgtcctctgggggcagcgtgctgcgcaagtgatgcccggccagggaacggggtgctggggccgcagtcaccgcaacttctgggtggagcagcgagggcccggggggctcgggaagctgggggtgtacccgcagccggggaagcggaggcacaggacctgggcccagggctcggagcccttgctccctccaagcgaggcgggacgagcacgggctgcgggacctccgccccgtgcccccgcccccctaggccggctgggagctggccaggggctcagaggtcgcacctctggccgcgggaggacgaggcggagccggaacggaagcgcggacaatgggccctccggggccgcttccggcctctctctgcggggcgggagcacgggagagcctggggcctggcctgggcggggctcgggcgccctccctgggttgccttcgcagcaccccagcctgggcccctcccacccctgccgccactgagcgcctactgtgtgcagcccagcctctgggggtgaggaaggcaaggctggaggtgagaacctggctgggagagctgactcgggcctcctgctcctccggcctttcctccttcctccttcctcccggtgggggagcctgacccccttggacaaacatcttgcggctgtttccgcctcgccagcccggagccccagcccagcctgaacaaacactcgggactcgtgcttccggccttggctctgggaaaagcccaaccaggagctgctgaggtcaaccctggagggaagtggaagggggaggcacccagtccctacgtagggtccccatagtgctgtcggcagagccagcagatgagggctggcagggaactaactgaagttattagggaagagcgcccacacacagcatggtcagcaccgctgtcccaccccagcagcagcagcgaccgcccagcacctgctgagctaggaggtggaggagcatccgcctgcagtgtctggccctcaggtcccagcggtggacgggacagaggaggaccctgccctgtgccatctgcagacgttaatcaaacgacacagctgccgtgcagagcacatgaggacggctgagccaccggggcaggcggggtgcagccctcagccggaggacccttgagctgagccggatgcatggggtgtttatgggctggggggaagtacaggtggtcgcaggcgagggggacggtaatgacgaaggcctggtgggaggcagtaggagcgcagggctccgcccttgctgtgccctgcctggaaggctctcttcaccctcctgactctgctgcatcctgcagatctcagccccaggggcccgaggaagatgggctggagtccccttgggagaaacttttccagaaccacctggcagcacgaggctgggatctgaacccagatccagggccacaggatgatgactccacagcctcgactggggtgccacctgcccctcactgggctccacccctggagaacagggaacagccagacctcagtgaaaatcccagctccaacttgggcggctcggtggccccaggcaagttgcttcctgtggggcctcagtcccctcctctgtaggtgggcctcacagtccctcccttgtgaagacggccttcatcctggattctcagtgacgttgtacacggccataagcccgccccatgtgctcctgctggcctggctgtctgatctgcccctgtgtattccctcagccctcctgccacggggtgtggtcactgttgtgtccctaaggcaaacagtaggttctcactcaacatccactggattagtcatggtcagacagacaccggttcaaatccaggaccagggcctcatctcctgagcctcaatttatgcacctatcaaatggggtcagcagcacagctgtttgatggcttttataaggactggctggcaaatgtttaacacacagaaggtgctcaacccacacaacgcccagtcctcatcagccctcggctttccctgctccttgtagctcctgtcattggggatgtggtcattaagcacctactgtctgtgcagggagcgcctgcctcccagcccactcaggcggttgtcgcctggagatggcagccagggaatgtgggtgggggcccccgcggcggccctgcccctctgaggcttctgctggacagaggcctcagtgtggagctgcccgggtcctttcacgggcccagacccatgactggacgtctgagaatgccgcccattatccaactcacagagcacaaaggggccatgcgggggctcggcaggccaggcgcccccagtgagcacacggggctccgggtccccaccccggcccatgagtcccctgagcacagagggcaaggacctgcccagagtcgggagagggcgtcgttcacatgcaggaatgagaaccatttcctccagccccacggggacacagagatgagaggaaccaccctgggggctgggtttgagggccagggcaggccatcgctcttgggcccggaaaccagacctggaaggtcgcctcctcctccagaagaggcagagagggaacacttcaggggccaggaggggcccctagaatgtgaagggtggcaaagcctc

SEQ ID NO: 464130 - DNA, 936 bp, Homo sapiens
tgtagattagctgtgaatatcttgactcctttaaggtaataaggcttttgtttgtttttatctttcacactagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacagggtaggaatctaatttctactttatttcctttgtaaaaatgaataaatttcttttagagtgtctttattttaaggaaaatagaggcattgtagaatagcagttcagacacaggccttgatataaccatgtgagggtgatggcctttcccagccgtggttcctcacctgtaaagagtgaggacagcagcacctgcctcggggtgagaaagcatggccctcagtagtcggtagtggctgccgtcagcttcacagcttacctctcccgattttagatgaggcacctgcggcccaaagagtcacatggggttttctggcaaaatctctcttgttttagtgggttctgtgtttatactgattcctgggatagataagtctgtcttctccgcataatgaaaatgaaaaactttaattttatacagtggcagttactttagtcactttaaaagttaagaagtgtcagtacagccaagaaaaaaaatcagcaaaactacaggttgggaaaaaatattttccaaaccatatatctaatgatatcttagtatctaaaatagaaa

SEQ ID NO: 464131 - DNA, 1061 bp, Homo sapiens
  misc_feature (905)..(905): n is a, c, g, or t
  misc_feature (914)..(914): n is a, c, g, or t
  misc_feature (924)..(924): n is a, c, g, or t
  misc_feature (928)..(928): n is a, c, g, or t
tgcgcagggactggcgggactgcgcggaggcgactgcagacgtatcgggggtccggagcctgtcgcggctgctaagcgctcggcgcctggcgctggcgctggccaaggctgtgagtccctgccgcggaccggggcagggcaggcgggggacgaggcggcggtaggagcgggacggtccccagcgggtccgagcggagcgggcgccgggtccccgcgccccctgcccggggatcgggaaggggctgggagagccctgggccggtgcgagggggagccgcggagtgtactcgggggcctggggagctcggtccttagcagtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcagaaacttctttgggcttgncggtttcangtttttctcnttancaattggagctttggtccctccgcggttcctggaattgaacttttgctgggttccccggtaaggtctatccagccttgctggtacacccgtgaccgacggccgacttttagtccattcaaggggggaatgcca

SEQ ID NO: 464132 - DNA, 3474 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagcttatttttcctgtctaactgaaactttgtactctttgatgaacttctccgctttccccatccaccccacttccctggattttattaaattaaattgtattatattgaatttaccagaattaatcactacattagaagaaactccagtgggtattcctaaaatcatggagaagtagatagatttaaaagcaaaagaaatgctgcaatttcttcagagttcataagagaacttctattggagaaatggaaaatttgagctggctaagccttgagacctcccaagactaagttataggagtttagccttctaaactacctcagggtacagcctggtcttaatttttaattttaaatttatttttatttttaatttatttttatttttatttttgagacagagtctcattctgtcgcccttgggcctcaattttaaggggggcccatattgagggtttcatgggaatcctctggccttcccaggttaaagcttttttttttggccttaattttcacg

SEQ ID NO: 464133 - DNA, 3143 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcacttcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagcttatttttcctgtctaactgaaactttgtactctttgatgaacttctccgctttccccatccaccccacttccctggattttattaaattaaattgtattatattgaatttaccagaattaatcactacattagaagaaactccagtgggtattcctaaaatcatggagaagtagatagatttaaaagcaaaagaaatgctgcaatttcttcagagttcataagagaacttctattggagaaatggaaaatttgagctggctaagccttgagacctcccaagactaagttataggagtttagccttctaaactacctcagggtacagcctggtcttaatttttaattttaaatttatttttatttttaatttatttttatttttatttttgagacagagtctcattctgtcgcccttgggcctcaattttaaggggggcccatattgagggtttcatgggaatcctctggccttcccaggttaaagcttttttttttggccttaattttcacg

SEQ ID NO: 464134 - DNA, 2820 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464135 - DNA, 3014 bp, Homo sapiens
tgcgcagggactggcgggactgcgcggaggcgactgcagacgtatcgggggtccggagcctgtcgcggctgctaagcgctcggcgcctggcgctggcgctggccaaggctgtgagtccctgccgcggaccggggcagggcaggcgggggacgaggcggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464136 - DNA, 2991 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagcttatttttcctgtctaactgaaactttgtactctttgatgaacttctccgctttccccatccaccccacttccctggattttattaaattaaattgtattatattgaatttaccagaattaatcactacattagaagaaactccagtgggtattcctaaaatcatggagaagtagatagatttaaaagcaaaagaaatgctgcaatttcttcagagttcataagagaacttctattggagaaatggaaaatttgagctggctaagccttgagacctcccaagactaagttataggagtttagccttctaaactacctcagggtacagcctggtcttaatttttaattttaaatttatttttatttttaatttatttttatttttatttttgagacagagtctcattctgtcgcccttgggcctcaattttaaggggggcccatattgagggtttcatgggaatcctctggccttcccaggttaaagcttttttttttggccttaattttcacg

SEQ ID NO: 464137 - DNA, 3379 bp, Homo sapiens
caggatacagatctcctgattcaggtgtccagtgccttttgaactgaacgcaagccctcctggacgattggaactgtaatgtggaaagggctctgatggagccagttaaaatgcttcattatttgcaaaataccacatacagtaatacgatctggatgtctttcccctcctccactaagtagcataagtgaagacttcccagaggaagtgcgcctttttcatctcgtatctgagtcatggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcagaaaaggagatcatctaaagaggaggattcagaatttaggttggggaagaaaagggcaagggtttcatttgtccctgtgctgctgtcttctgggactctctgaggggaagcacttctgatctttaacacatgcccgtaaatgccgttgggaagatttgttaatacaattatgtggagagattcatggagtaccttttctgtgccagatacgttagcgggtggatttgggcctggaagacaaagctggggctcctgtttgtggcttgtaaggagtggttggtgtttccaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464138 - DNA, 2272 bp, Homo sapiens
taccctgcacctctcttctgatgggactcactgaacgctaagctgtgctttgtgaacccctgtgaactgaagctagacaacttaaacttcagaagaaaataacagcaacctgtttacatatataagctactgtcataccggcctactgatgtatggacttcagagtagtgtggcctatatcgattttctaggatcattattttgtttgttgtttttctcccttcctccacctattttctcttcataggacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464139 - DNA, 1660 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactattttgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464140 - DNA, 1424 bp, Homo sapiens
agcttcggtacacccctacgttgttagaagtgttcaatagcatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464141 - DNA, 1284 bp, Homo sapiens
ggtgatagctgactctagaggatacacagatgacgcggagaacctcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464142 - DNA, 465 bp, Homo sapiens
gtaagacggtggtgggcacacacagccaaaggaagtaggggtacaggggagtgcgactctgagtatggagtctattacttggcaggaagcacttctgatctttaacacatgcccgtaaatgccgttgggaagatttgttaatacaattatgtggagagattcatggagtaccttttctgtgccagatacgttaggtaataagcatattacaggtagcctttcactcactgctccagtcagcccttcctggagttccctctgtctccaccacacagatgaggagactgaggctaagggatggaatcactgggtgagtctgggaggggttgtgatctggaatctgtcaggcctggctgctcctctgctgaggtcagccctcactgggagtcaccatgtgagtagttggctttctctgaatcccccagcgggtggatttgggcctggaagacaaagctggggctcctg

SEQ ID NO: 464143 - DNA, 1723 bp, Homo sapiens
agcgtgttgctgtggttggtgctgactgagcagagacccccgccgcatcttgggctcttaggagctgctgggagggcgtccacaagcaggaggtgaagcccatggtcagtgggactttttaggggcagtggacactaaccctctggatctgtgtcttctgtgtctccagtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcagaaaaggagatcatctaaagaggaggattcagaatttaggttggggaagaaaagggcaagggtttcatttgtccctgtgctgctgtcttctgggactctctgaggggaagcacttctgatctttaacacatgcccgtaaatgccgttgggaagatttgttaatacaattatgtggagagattcatggagtaccttttctgtgccagatacgttagcgggtggatttgggcctggaagacaaagctggggctcctgtttgtggcttgtaaggagtggttggtgtttccaggttggaatcaatgctgctctggggaacatggaggaggacaactggaggtggcatttctatgacaccgtgaagggctccgactggctgggggaccaggatgccatccactacgtgacggagcaggcccccactgccatggtcgaggtgatgggcgggaggctctgggtgctctcgtggtctgtttctagtacaagagtcctggaaaaaatctcccatctgggctgtgaccccatggtctgcggacctcactctggcaccagactccgagtggagctgcatgcggccaccggacagtgtggagtgcctcttcgggtttctctgagatatgataccagctgttttgtggagtattttgccttggatctcctgatagagaacagggagtgccgtggtgtcattgcactgtgcatagaggacgggtccatccatcacataagagcaaagaacactgttgttgccacagggtaggaatctaatttctactttatttcctttgtaaaaatgaataaatttcttttagagtgtctttattttaaggaaaatagaggcattgtagaatagcagttcagacacaggccttgatataaccatgtgagggtgatggcctttcccagccgtggttcctcacctgtaaagagtgaggacagcagcacctgcctcggggtgagaaagcatggccctcagtagtcggtagtggctgccgtcagcttcacagcttacctctcccgattttagatgaggcacctgcggcccaaagagtcacatggggttttctggcaaaatctctcttgttttagtgggttctgtgtttatactgattcctgggatagataagtctgtcttctccgcataatgaaaatgaaaaactttaattttatacagtggcagttactttagtcactttaaaagttaagaagtgtcagtacagccaagaaaaaaaatcagcaaaactacaggttgggaaaaaatattttccaaaccatatatctaatgatatcttagtatctaaaatagaaa

SEQ ID NO: 464144 - DNA, 2964 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464145 - DNA, 2633 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcacttcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464146 - DNA, 2481 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464147 - DNA, 3028 bp, Homo sapiens
tgcgcagggactggcgggactgcgcggaggcgactgcagacgtatcgggggtccggagcctgtcgcggctgctaagcgctcggcgcctggcgctggcgctggccaaggctgtgagtccctgccgcggaccggggcagggcaggcgggggacgaggcggcggtaggagcgggacggtccccagcgggtccgagcggagcgggcgccgggtccccgcgccccctgcccggggatcgggaaggggctgggagagccctgggccggtgcgagggggagccgcggagtgtactcgggggcctggggagctcggtccttagcagtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464148 - DNA, 2950 bp, Homo sapiens
tttataagatccttttgcggtgcctttctacagacgtgtcgggggtcggggctgttgtggttgcaagtgctcggtgcttggtgtggtgtggcaaggtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgggatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaggaggatggggccagaggatcgcttgagcctaggtgtttgacaccagcctggacaacattgtgagactctgtctcaaaaataataaataacaaaacaaaataaaatatacaatgcattattatttaatacagtcattattctatgcaataaatcactaaagctta

SEQ ID NO: 464149 - DNA, 1543 bp, Homo sapiens
tgcgcagggactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaattgccatggtctccatgaactgatttttttgtgcagtgggcaggaagaacccatcgggcagctacacatcttgaaagagaagctcttctggaacgcagaacctctggacttcacagatgcctgggga

SEQ ID NO: 464150 - DNA, 3227 bp, Homo sapiens
tatttattcagtgcggattgcagagggcgcagctccaccgtggtaacttgcaatgtggccgcccctgcgctggcttctttctcctcggccctcggtgaacccagcttttcctttaaagcatagacaaatccttgcttagggtcagccagaccgtgggcttgctttgggctcccgcgtggacgctgaaggctcttcatgatttctcagaaaccttggtgggccacccaaaaagtgtgttggaaatccacggtgatccttaatatggtgatgggattgtccgaaaaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatgaaactgtctctcgatttcttcatttattagcctgtactattatgatgatttttgcttatttgctttgactttttcttcttacacacccattttacttctttccctatagatgttgaatctagacataggtgagcccaaattatgaactggataattaggttggtgcaaaagtaattgcagttttgggtcatttttaatggcaaaaacacagttacttttgcaccaacctagtatttcctggaaagtgcattaatcaaaattttgtaatccaaattatcttttaacaaatgctcaagtgagttattttgtacagtaaaaattttttgtaatactctctccctactttgactattttgtaagcatgaggttttgtgtatattatagtttcttgaaatggggcatatctacagtagaagcttttttaaatgtttatcctaacttttaagttaataaaaagttagatttatcagctagacttaatgaacttagttctgtagatatgctaggagtcgctggtactgtcactttaataaagcattctagaagttaccaagggaataattcacagtatcagagacatttcaaaaacattcctgtccctgtcttttcacttgtttcgtaagtctaatgtggcctgaccaaattacacctcatcaagtcctgtgcaataagaaacctgaaggcctaaaattttacgtagaaaaagtgttttaaatcttatttttt

SEQ ID NO: 464151 - DNA, 2641 bp, Homo sapiens
gagtggaggtggaggtggaggcaaggagctgaaattctgcgtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatga

SEQ ID NO: 464152 - DNA, 2546 bp, Homo sapiens
ttgtaaaaactggttcttggaaaggggctgcagaagacctcccgaggtggatgttactgagccgcccggcgagcaccagccgtgacaggtccgggcccggccgcgcggagccgcgggagaactgccctccgcagccggaagggggccgcggggagcgctcctggccggtggcggcgggggcgggggaggccgcgagccgaggcgctccaactccggcgatgccgcctcgccctccccgccgcggttgatgcggcacgtgcacgccgccgcccgcaccaggacctgggccgggtcgcacggcttggcccccggccaccgcttcggcctaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatga

SEQ ID NO: 464153 - DNA, 2676 bp, Homo sapiens
gagtggaggtggaggtggaggcaaggagctgaaattctgcgtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatattctttacaataaaaaagtttaacagacttttgtcttaaaaatagtcagaattcaactttgtgatttatacataaaatatacaaaaagcaccacaatttgtggttagtcgcacc

SEQ ID NO: 464154 - DNA, 1949 bp, Homo sapiens
gagtggaggtggaggtggaggcaaggagctgaaattctgcgtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggataaaccgcgagggtaccgagctc

SEQ ID NO: 464155 - DNA, 2502 bp, Homo sapiens
tatttattcagtgcggattgcagagggcgcagctccaccgtggtaacttgcaatgtggccgcccctgcgctggcttctttctcctcggccctcggtgaacccagcttttcctttaaagcatagacaaatccttgcttagggtcagccagaccgtgggcttgctttgggctcccgcgtggacgctgaaggctcttcatgatttctcagaaaccttggtgggccacccaaaaagtgtgttggaaatccacggtgatccttaatatggtgatgggattgtccgaaaaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatga

SEQ ID NO: 464156 - DNA, 424 bp, Homo sapiens
ttgtaaaaactggttcttggaaaggggctgcagaagacctcccgaggtggatgttactgagccgcccggcgagcaccagccgtgacaggtccgggcccggccgcgcggagccgcgggagaactgccctccgcagccggaagggggccgcggggagcgctcctggccggtggcggcgggggcgggggaggccgcgagccgaggcgctccaactccggcgatgccgcctcgccctccccgccgcggttgatgcggcacgtgcacgccgccgcccgcaccaggacctgggccgggtcgcacggcttggcccccggccaccgcttcggcctaggatttcagatgcatgccaggtttccactgattgccagaactcgagatcactacacatggatccccaaacctcactctcttcactcctccccgcta

SEQ ID NO: 464157 - DNA, 2857 bp, Homo sapiens
tatgcgaagaggggctagcactcggtgtgtggaccaaatgcgtgtttgtttaggcattgttggcgaccgaatcccgagtgaagcattggtttaaaacctgaatttcccgtctctgtgtattgattcctaacgcgcagaggcgttgcttgaacgttgtttgaactcctaggcattccagggggcaaaagcacctcggcaaaaacgtgcaggactgcatgttactttggttcgcggctgacacgccgactgtgcgccggcctgtcaatcaccgggagcagcaacagggagcacatggcaacgggctgcgggcgagctggccagcggcccgcccggggtcccagcccttcgaagaaagggacattcacgagcttctatctctaattctctgtcgcaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatga

SEQ ID NO: 464158 - DNA, 2013 bp, Homo sapiens
gagtggaggtggaggtggaggcaaggagctgaaattctgcgtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctcccctcactctcttcactcctccccgcta

SEQ ID NO: 464159 - DNA, 2609 bp, Homo sapiens
tccatgtcttcaccacagaaaatttttactgcttgtcactaggtgatccttacggattattacagaatccttccatatgccagatactagtctaaatgtttacacaggtcacatgaaatggttgagcatggaccctgttgctacccacagctgccatctgctacagcaactgcatgatcagtgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgtgttatcagtgaaaactacccccctcatttactgcaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcataaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggcaggtaacttgcagactcacttacgacggcattctggtgaaaaaccatacatctgcgagatctgtggaaagagggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatattatatgtt

SEQ ID NO: 464160 - DNA, 1421 bp, Homo sapiens
tgaattttcaaattacattctaggtttgcagcctctggcgacgtccagcgtcacattattattcactcaggagaaaaaccacacttgtgtgacatctgtggtcgagggtttagtaacttcagtaatttgaaggagcacaaaaagacacacacggctgataaagtcttcacctgtgatgagtgtggaaagtcttttaatatgcaaaggaagttagtaaagcacagaattcggcacacgggggagcggccttacagctgctctgcctgcgggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatattatatgtt

SEQ ID NO: 464161 - DNA, 1950 bp, Homo sapiens
gctgatacctccaaggcctatcaggatggtcagccatcccagctgcttctgtcccgctgcagcagcaagaacttcctctgaaagcgcctctgcatgcctccctctgggcgcagctctgtttggggctccttcaggggagggggacgggggttcatccctttcttttgtgctgcctttccctcccacttccgctcccctcgctgctccagtgacctttcacccctcccttggacgtccctcaaaggcagctcccgtggttaataacttcggctggcagccccacataaagccagggccggaaatcattgtcccggggacaatggccgagcagcccaataatgaggtggccatagtgttgtctgacatcccacgttgccctggcaaagggggaggggcagcggggctcgccatgccctcgcctcctggagttgaattcttccgctcgcacatggtggttcctctttctgaggcagcaccacgcacctgtgccctccagtggctgcatttccctgggactgcatgctgaggggatgtcacccagagaccccgacccccctcaacacacagcaccgttgttactttgcctcattttcctgctcccatgtcccagggagccagtcagtaccgcatagtagggcaattgatcggttctggctaatccataagggaggggagatctcagcctgccgcccaatggggagcatgtggcactctggaaagagcatgtgctctagagccagagggcatgggttcaaggtctcccttctacctttctagctgtgtgactttggggaagctgcttgacttctctgagtctccacttactaatctataaaagcagaagtcggatgggagctgagaggaggactctcacaagcaacctcagaggtgaataactgtgacctccaagaagtcaccatgtccttgccactctggtgggtctgggcatcttctgctgggctggcagagtaggaggcagaccaggctgctggaagcagcagctccagggcagtgctctctgcctttatctggtttgagaagcaggatgtagctgtcttccatggggcctgccataatatgaaagggactcatgccttttgacattatccaagatgctgggataggcctggtgactgcccagctcagttcctcattttataagtaatgtttaagagcaatgacccactcctactttcagcaaagaggtgcacatagcatagacccatagaagaggaaggatctgagaaggagtttgaaaaaagtgtaggagaggctgcgagaaaacaaggcaggtgtcctggctgagggcaggaaggagacattgcgatggaaattgtgccccattttcttggaggattgggaagaggacctgtggactgggcggcccacacaactgctgtaacctcaggcagttttcaagcagattgaccttcctgctggaacacggcacatgagggttgcttggccttgcctccaccatgcctgacactggcgctctgctgggaggaaaaagcttgctctgttgctggctgtgtggaacagagagggaagtggcagacagtctgggcccagcacttgggtatcgtgctctagccatgcgactcatctctccagttcagacctgcccctggaaaaaagagcccagacctcatcatgaatgctttcctaggagaaaatgaacagctggacaatgctcctggtcagtaggcctgaaggatgctgggatgcagccctcaagatggaacagccaggatgccaagtatccctcttgcccagatcctaaggcactttttctactgatccatattggcctcaggagatgtctcaacacagcaccccagccaatggagctgccacataagatgaactcttgatcatctctaaactagagagttaaactcaacactagcaaacgactttgggtttatgcatatgtcatgttttctctgg

SEQ ID NO: 464162 - DNA, 724 bp, Homo sapiens
gttcctcattttataagtaatgtttaagagcaatgacccactcctactttcagcaaagaggtgcacatagcatagacccatagaagaggaaggatctgagaaggagtttgaaaaaagtgtaggagaggctgcgagaaaacaaggcaggtgtcctggctgagggcaggaaggagacattgcgatggaaattgtgccccattttcttggaggattgggaagaggacctgtggactgggcggcccacacaactgctgtaacctcaggcagttttcaagcagattgaccttcctgctggaacacggcacatgaggtgaagttctcctctacccaggtctgtccttagcaccttatgcagggtttaacccccatgggcataaacagggtgtgtatctggggtggtttggggattaggtcccatgagcactgggacctgaagatgcttggtctagagaagggacggtgtttggtctgggaaacatgggggtcatgtttaatattatatagacagtcacatgggatatttaattagcaatgtggaatttagagagaggcaggtttcacttcacctttgggaagtactaggttctaacacacctccctcgcctggaaagagattgaactaccacagattgaatcccttgggaggaaggaatttcagtccctgaatgtggacagctgaggctggatgagaacagagagatgtcagatgtccaagcttctgtgt

SEQ ID NO: 464163 - DNA, 1971 bp, Homo sapiens
gctgatacctccaaggcctatcaggatggtcagccatcccagctgcttctgtcccgctgcagcagcaagaacttcctctgaaagcgcctctgcatgcctccctctgggcgcagctctgtttggggctccttcaggggagggggacgggggttcatccctttcttttgtgctgcctttccctcccacttccgctcccctcgctgctccagtgacctttcacccctcccttggacgtccctcaaaggcagctcccgtggttaataacttcggctggcagccccacataaagccagggccggaaatcattgtcccggggacaatggccgagcagcccaataatgaggtggccatagtgttgtctgacatcccacgttgccctggcaaagggggaggggcagcggggctcgccatgccctcgcctcctggagttgaattcttccgctcgcacatggtggttcctctttctgaggcagcaccacgcacctgtgccctccagtggctgcatttccctgggactgcatgctgaggggatgtcacccagagaccccgacccccctcaacacacagcaccgttgttactttgcctcattttcctgctcccatgtcccagggagccagtcagtaccgcatagtagggcaattgatcggttctggctaatccataagggaggggagatctcagcctgccgcccaatggggagcatgtggcactctggaaagagcatgtgctctagagccagagggcatgggttcaaggtctcccttctacctttctagctgtgtgactttggggaagctgcttgacttctctgagtctccacttactaatctataaaagcagaagtcggatgggagctgagaggaggactctcacaagcaacctcagaggtgaataactgtgacctccaagaagtcaccatgtccttgccactctggtgggtctgggcatcttctgctgggctggcagagtaggaggcagaccaggctgctggaagcagcagctccagggcagtgctctctgcctttatctggtttgagaagcaggatgtagctgtcttccatggggcctgccataatatgaaagggactcatgccttttgacattatccaagatgctgggataggcctggtgactgcccagctcagttcctcattttataagtaatgtttaagagcaatgacccactcctactttcagcaaagaggtgcacatagcatagacccatagaagaggaaggatctgagaaggagtttgaaaaaagtgtaggagaggctgcgagaaaacaaggcaggtgtcctggctgagggcaggaaggagacattgcgatggaaattgtgccccattttcttggaggattgggaagaggacctgtggactgggcggcccacacaactgctgtaacctcaggcagttttcaagcagattgaccttcctgctggaacacggcacatgaggtgaagttctcctctacccagggttgcttggccttgcctccaccatgcctgacactggcgctctgctgggaggaaaaagcttgctctgttgctggctgtgtggaacagagagggaagtggcagacagtctgggcccagcacttgggtatcgtgctctagccatgcgactcatctctccagttcagacctgcccctggaaaaaagagcccagacctcatcatgaatgctttcctaggagaaaatgaacagctggacaatgctcctggtcagtaggcctgaaggatgctgggatgcagccctcaagatggaacagccaggatgccaagtatccctcttgcccagatcctaaggcactttttctactgatccatattggcctcaggagatgtctcaacacagcaccccagccaatggagctgccacataagatgaactcttgatcatctctaaactagagagttaaactcaacactagcaaacgactttgggtttatgcatatgtcatgttttctctgg

SEQ ID NO: 464164 - DNA, 760 bp, Homo sapiens
tgagttcatgtcctttgtagggacatggatgaagctggaaaccatcattctcagcaaactattgcaagaacagaaaaccaaacaccgcatgttctcactcataggtgggaattgaccaatgagaacacttggacacaggaaggggaacatcacacacccccagggcctgtttctcctgtggctgcagccagaggtagtcaagactggaacattcaaaatggcatctccctggagacagatcaaaagctggaatcttcctctggcagctatcttcaaaagtaccacctccaacactggggatcaaatttaagcacggtatttgaagaagacaaacatccaaaaaatggcaaggatcttaagaaaatttttcatgataatctgagtggaccttacttgaattcattgaaagagtttaagtgtggaactggaggggaaaaaaaaagtcactatggattacagcttcatctcctgcccaagagataacagcctgacctttctggaagcctgccttatagacttagaacttgtctattgagccaccagagtggtaactcaacacttgatcttccacccaaacatgttccttgcccagtctacaccagcattattttatgtgatcccacccttgtcttttccaatttcagctacaataaagcacaagcataattctttataactcccttgtttaaaacctttcacatttggcttttcatatttaacattaattttggtacctatcacatggcctacaagaccctac

SEQ ID NO: 464165 - DNA, 795 bp, Homo sapiens
  misc_feature (6)..(6): n is a, c, g, or t
  misc_feature (8)..(9): n is a, c, g, or t
  misc_feature (11)..(12): n is a, c, g, or t
  misc_feature (14)..(14): n is a, c, g, or t
aaaatnanntnntnagggttaagccactgggtctgcggtgctctgccatggcagccccgcaaactaatccagatgctgagagaatgtacaagttttttgtttggtttgtttcattggtaggtctcactgagaaaaatgacatcagaacaaagacctgtggaagagtcagttatataaatatttgggggcaggagcattctggaagaggaaaaagcaatccccaaagccctgatctggaaggaggccagggaggtttgatacatagagcattagaagatgaggttagaaaggttggaacagcgaggcagtggcagatcacaggagagaagggttctcagtggatgcagggccgtactgtgcaccaatgggatattttgaaaaactgtgaggaattttggcattactatgattggggtggtggtaatgttagtgggcaggcaacatttatgttaaaagaatagccatgctcaggacccttccacccagcaaagtattttttctacaatcaatgtgacttttaaatgccctgctgctcattcatggagatgtaacactttataaccttttatgctaacttctaaactccactaatggcaaaataggttatgggatcaactcttcattaaacaagtaaacattctggataaatatatttgatcatatttggggaatctttgctaatactttttcaagtatttttctgcctgatagtttctctctttgacttctaaaagtccaatttcatgtaagttagatgtcttgacattatttcatgggtcactgatgttctgttta

SEQ ID NO: 464166 - DNA, 646 bp, Homo sapiens
  misc_feature (24)..(24): n is a, c, g, or t
cctagctgcaacgactctcttaanatccaccgctacacgcccactttcaaaggacttaacttgattttgaatgaaaagacatgcagaaatgttaacgcatttcctcaaagttacagggaggtggccaagatggtcgactagaagcagctagtgtgcgtggctctctcggagaggggcaaaaggggcaggtaaattcagcaccttcaactgaaacatctaagtacttgcattgggactaatagaggaaacaactcaacccatggagaatggagaaaagccaggcaggatgacggcccacgcaggcatgacacagagacaaagtaacctccccagcccagcgaagtgccttcaatggtgatacctccaggtacaggaaaatctgaggtgactagagactgaagtgggcccccagcatacctcagcagccctacagaaaagtggccagatgtacattggtgcccacatttcctcaccagacagttcctctgggactgggcttccagccacctcttgccagagctgagtgagtagaaacttggcaactccctggacagagcctccaagggcaactgaaagcctctctgccactgcctctgcagtggaactgctcttgcttcccttggagtaatgaagtagcaaagacccc

SEQ ID NO: 464167 - DNA, 1258 bp, Homo sapiens
  misc_feature (24)..(24): n is a, c, g, or t
cctagctgcaacgactctcttaanatccaccgctacacgcccactttcaaaggacttaacttgattttgaatgaaaagacatgcagaaatgttaacgcatttcctcaaagttacagggaggtggccaagatggtcgactagaagcagctagtgtgcgtggctctctcggagaggggcaaaaggggcaggtaaattcagcaccttcaactgaaacatctaagtacttgcattgggactaatagaggaaacaactcaacccatggagaatggagaaaagccaggcaggatgacggcccacgcaggcatgacacagagacaaagtaacctccccagcccagcgaagtgccttcaatggtgatacctccaggttggggaagaaacataaggactgagatcaccggagagatacagtgggcagcccaggagtgccaagccaccttctacagccagcactcaatgggagaggaacccacactttcagagagcattgagaaagaaaacagttacaactgagaggaaacaggggagccacatagctggacaagagtctaccagctgaccagtatgcctaagtgccacctactggatcacaccccaaagcttcaacacaaaaaatactttgctagcatactttcttccaaaaccagagacaaaaaatcagcttcaaataaaaaccttgcacaaagcctcggcctgggtatatgtgcacaacttaaccaggccaagctggctgcaatgacaggaatagaatttggaatttggctaggaacaaagatcatcaagtttcaacaggaaggcaaaacccaatctaaggaaaataagaatcacaataaggcaatacagggggtgaaggacaaaatagccagtataaaaaggaacctaataggtctgacagagctgaataacgcaaaacaagaatttcacaatgcaatcacaagtattaacagcagaataaaccaagctgataaaagaatctcagaacttaaagactggttaactgaaataagacagtcagacaaaaataaaggcagtgaacagcagagtgggggaaaatagatttgtttttattcagcaaattatctgtgtcagagtctttcttagtcaacatttaaaaatgaactcaatttattcctttcaataacttttttgagatttaatgaagttttaagtttgaaaagaagcaggcaaggctaccacaatgaaagaagtaaacaacattctcaaagcaccctattcatgatttttaaaatgtgctatc

SEQ ID NO: 464168 - DNA, 4315 bp, Homo sapiens
tggcagtctcatcaccatgctggaacaagcaagtgccagcccatcttttcactcattgtcttatttcctcaaggtccaaattctagggaatgaattcagacaatccagcttgatccatatgcccaacccttgccttcccggagaccctgatgagtatgagcctaccttggaagccacagttcctccaggactaagggacattcacactcacatccacaaaccgtcaagttctgtaacagcactaatagcaggaagcttttctccaactttgaccaaagaagctaaggcaagagagactcggccaccagggaaggacccagctctgctgcaggaaggggagagaacggagtcgggttgtacttttactcagaagcacaacgaccatctaacagaggacagagtcatcagggacacgctaagaagatggtgggtggcctccaggacggcggcttccagggccagcgcttccgcgggctcctcctcgtagtctgacagaaactgcagaaagtaatgagggtgggcacccatcagccagcccaaggttccaggccgccgcagccgttccacgctattaggtgtctggatggcaggagtgactgatttataggctcctgcagagtggcccatgtgagacccagcctgggaagagaggtggcctgtcctggatggaatgaccacagatccccttccagagagaaggacacagatacagttactgctgtggcctcctgtttaccactttacagttctgcaaaatctctctactctccttcgttacataacaagagccaagcgcggggatgtgtccctttcggagacagcaacgtggccagagggctctagctccaaaaggacttactccttggccagtcggcaagtcttgaacatgttcttcatgtgacacagctggacccgcagcagctgaaaagaaagagaggggggcaggagtgggagggagatgtgagaagaggaatccagtgtgggaagcccagggcctttaaaccctggggttctagaagccttgcatgctgcacccagagcagactgtcctacgctctgacaactggctccagactgtcctatgctctgactcgacacctggcttcagattgtcccacactctgactgacaactggcttcagactgtcctacgctctaactcgacacctggcttcagactgtcccacactctgactgacagctggcttcagactgtcccacgctctaactcgacaactggttccagactgtcctatgctctaactcgacacctggcttcagactgtcccacactctgactgacaactggcttcagactgtcctacgctctaactcgacacctggcttcagactgtcccacactctgactgacagctggcttcagactgtcccacgctctaactcgacaactggttccagactgtcctatgctctaactcgacacctggcttctgactgtcccacactctgactgacaactggcttcagactgtcctacgctctaactcgacacctggcttcagactgtcccacactctgacagctggcttcagactgtcccacgctctaactcgacaactggcttcagactgttgtatgctctaactcgatacctggcttcagactgtcccacactctgactgacaactggctccagactgtcctatgctctgacaactggcttcagactgtcctatgctctaactcgacaactggcttcagactgtcctatgctctaacaactggcttcagactgtcctacactctgacaactggcttcagactgtcctacgctctaactcgtcaactggcttcagactgtcctatgctctaactgacaactggcttcagactgtcctacgctctaactgacaactggctccagactgtcctacgctctaacaactggcttcagactgtcctacgctctgactgacaactggcttcagactgtcctacactctgacaactggctccagactgtcctacgctctgacaactggctccagactgtcctacgctctaactgacaactggcttcagattgtcctacgctctgacaactggctccagactgtcgtatgctctaactgacaactggcttcagactgtcctacgctctaactgacaactggctccagactgtcctacgctctaacaactggcttcagactgtcctacgctctgacaactggctccagactgtcgtacgctctaactgacaactggcttcagactgtcctacgctctaactgacaactggctccagactgtcctacgctctaacaactggcttcagactgtcctacgctctgacaactggctccagactgtcgtatgctctaactgacaactggcttcagactgtcctacgctctaactcgtcaactggcttcagactgtcctacgctctgacaactggctccagactgtcctacgctctgacaactggcttcagactgtcctgtgctctaactgacaactggcttcagactgtcctatgctctgacaactggcttcagactgtcctatgctctaactcgacaagtggcttcagactgtcctacgctctgacaactggcttcagactgtcctacgctctaactcgacaagtggcttcagactgtcctacgctctgacaactggctccagactgtcctatgctctgacaactggcttcagactgtcctacgctctgactgacaactggcttcagcctgtcctacgctctgactgacaactggctttagactgtcctacgctctaacttgtcaactggcttcagactgtcctacgctctaactgacaactggcttcagactgtcctacgctctgacaactggctccagactgtcctacgctctgacaactggctccagactgtcctacgctctaactgacaactggctccagactgtcctacgctctgacaactggctccagactgtcctatgctctgaccactggctccagactgtcctacgctctgacaactggcttcagactgtcctacgctctaactgacaactggcttcagactgtcctacgctctgacaactggctccagactgtcctatgctctaactgacaactggctccagactgtcctacgctctgacaactggctccagactgtcctacgctctgacaactggcttcagactgtcctacgctctaactgacaactggctccagactgtcctacgctctgacaactggctccagactgtcctacgctctgacaactggctccagactgtcctgtgctctgacaactggcttcagactgtcctacgctctgacaactggctccagactgtcctacgctctgacaactggctccagactgtcctacgctctaactgacaactggcttcagattgtcctgtgctctgacaactggcttcagactgtcctacgctctgacaactggcttcagactgtcctacgctctaactgacaactggcttcagactgtcctgtgctctgacaactggcttcagactgtcctacgctctgacaactggctccagactgtcctacgctctgacaactggctccagactgtcctacgctctaactgacaactggctccagactgtcctgtgctctaactgacaactggcttcagactgtcctgtgctctgacaactggcttcagactgtcctacgctctgacaactggctccagactgtcctacgctctgacaactggctccagactgtcctacgctctaactgacaactggctccagactgtcctgtgctctaactgacaactggcttcagactgtcctacgctctaactcgacaagtggcttcagactgtcctacgctctaactgacaactggctccagactgtcctacgctctaactcgacaagtggcttcagactgtcctacgctctaactgacaactggcttcagactgtcttacgctctaactgacaactggcttcagactgtcctatgctctaacttgctctaactcactctgacaactggcttcagagtgccctctagtcagggaaggcccctccgccaggtctgtctgcccgagtcacataagcagtctgggcagaggagtgctccgaaattccaatttcttactcgatacccgattcctcattcattcactaatgtttttagtgaaggaagaaattctgcttttgccctcaagtgctatctacagcttcctagctgccattgccacgtttgaggctccaactagacagataacctgggaaatgggaagagattaagaaagtacatagtgagggcatgaacggagagacggttatagctttgacactgc

SEQ ID NO: 464169 - DNA, 957 bp, Homo sapiens
gtaagtgtatatgtttgtctcagatctacgcctagagtggaatagccacggcggtgtcccaccaggaggcccgagccacagcagcctcccggtgggacgccgccaccccccggtgctacgcatggtgctggaggcgctgcaggctggggagcagcgccggggcacgtcggtggcagctatcaagctctacatcctgcacaagtacccaacagtggacgtcctccgcttcaagtacctgctgaagcaggcgctggccactggcatgcgccgtggcctcctcgccaggcccctcaactccaaagccaggggggccactggcagcttcaaagaccaggcggctaagcagggagaagagccagaggggcgtcaggtgtctgatgcggtgtgctggcagttgaggggtgaagttagttcccaagcacaagaagaaaatccagcccaggaagatggcccccgcgacggctcccaggagagcgggtgaggccaaggggaagggccccaagaaaccaagtgaggccaaggaggaccctcccaacgtgggcaaggtgaaaaaggcagccaagaggccagcaaaggtgcagaagcctcctcccaagccaggcgcagccacagagaaggctcgcaagcaaggcggcgcggccaaggacaccagggcacagtcgggagaggctaggaaggtgccccccaagccagacaaggccatgcgggcaccttccagtgctggtgggctcagcaggaaggcaaaggccaaaggcagcaggagcagccaaggtagttgtgtgacttgtagggggtggtgtggggatgggggtcttgacagccactggagcgggggcggggagccagctctggagaggggtttccttatctagtgcatgtgtcctgagtgctgggcttgacctggagagagagaactcatggtagctggttgggggaaggaggcagacatttcaaggg

SEQ ID NO: 464170 - DNA, 2565 bp, Homo sapiens
gcatccgcaagatctctctggaccagctcgggtgcagggcctctgcgggagccctcctagacctctgcggcttctcctctaacatggccgactcggaaaaccaggggcctgcggagcctagccaggcggcggcagcggcggaggcagcggcggaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtttagctgtgaaaatcatcagaactcttcactgaagctaatgtttggaaaaaatacatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtggtgttaataaaacagtattttcaaaaaatatatataaaagactcggtactgtgactgcctgcattcaaatcccagctctgcctcctattagtaatgtaccttaggcaactcagctaatactctcagtggccagtttctcctcatctacaaaagggaataggaatagtcccttcctcatgggttactatgaagagcaaatggattaatacatataaatcctatagaatagcatccaaaccatgaaaggataaaaaaggctatttcaactttatgtttgcttcattctgaatgaagcagaaagttttttttaaaaactggactccagaaaaattaaaaaatcagatgccatttgcttccttttcccctgaagggttaaaattacaaagaagcaaaattatattgctttatcctagggaatggaaggcagcactgacctgttgctaatcacaacagattgttgagtacaaacaaaccttaaggtaaagttaatcttcattatgctcaggccaaccaaaagagaaaatcagaataatacgttacatacaaagttctgattatcttaatcatatgattatcttaatagagaaaaaatctaataaaatttaatattgatttcttatatccaggaatgagagaaactatcattttactatttttctggttccagtaaaa

SEQ ID NO: 464171 - DNA, 540 bp, Homo sapiens
ggtacaagtgacaagaacgattctgtttcgaacacagccacagaaataaaagatgaacaaaaatctgggacagtgtcttctcagaaacaaccggccttgaaggatacaagtgacaagaacgattctgtttcgaacacagccacagaaataaaagatgaacaaaaatctgggacagtgcttcctgctgttgaacagtgtttaaacaggagtctctacagaccggatgctgttgcacagcctgtgacagaggatgagtttgctttggaatctgagattatttcaaaactatacatcccaaagagaaagattatttctccacgatctatagaagatgtgcttcctcctgttgaagaggctgttgacaggtgtctctacctactggaccgttttgcacaggctgtgacaaaggataagtttgctttggaatctgagaatatttcagaaccatactttacaaacagaaggactatttctcaacaatctgcagaaaagttagatgctgcatgtggcattgccaaaacagactgcaccttctcccag

SEQ ID NO: 464172 - DNA, 426 bp, Homo sapiens
catttttgaactaatttatgaatatgaaagaaagaaacatgaagagctttctataaatagcaatccaggtaagatttctgatagtgaattactcttgatggtactaccatagataaaaaagaataaagatgttttgattacaaaaaagcagtttaaaaaaatcactgtttaaattgcacacatttaaaaaatacttagtagtctagattttataattatttaaaaagttaattgtaggtaatttataatctcagtattgtatgaaaaaaattattatttaattatggttcctaatattctagatgatctttttgtgtaaataagaaaacaaatttttaagttattatgttgtatttttttatagtcacatgataatgaattagactttttatataattagaacttctatttaatttgtaaaataaa

SEQ ID NO: 464173 - DNA, 2809 bp, Homo sapiens
agggcggtttctctgcctcgggcctgttgggcagggccggctaaggtgcgcgtgctcgctggttctaacccttctgttgggcgtttctgctgagaggcgggaggcgctgagagtctgtgcgaaggtccgtggacagactgctttgcctgttgttgctcttcggaggcggcgatccccgaaggcgagctgaaatacggctgcaggctacaatttgcagccgaccattatggatgacaaggagccgaagaggtggcccaccctcagggaccgcttgtgctcggatggcttcttatttccccaataccccattaaaccgtatcatctgaaggggatccacagagctgtcttctatcgtgatctggaggaactgaagttcgttctgctcacgcgttatgacatcaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcatatggtgcaaatattgaagaatgcagcgaggatgaatatccgccactgttccttgctgtgagtcaaagaaaagtgaaaatggtggaatttttattaaagaaaaaagcaaatataaatgccgttgattatcttggcagatcagccctcatacatgctgttactcttggagaaaaagatatagtcattcttcttctgcagcacaatattgatgtgttttctcgagatgtgtatggaaagcttgcagaagattatgccagcgaggctaagaacagagtcatttttgaactaatttatgaatatgaaagaaagaaacatgaagagctttctataaatagcaatccagtgtcttctcagaaacaaccagccttgaaggctacaagtggcaaggaagattctatctcgaatatagccacagaaataaaggatggacaaaaatctgggacagtgtcttctcagaaacaaccggccttgaaggatacaagtgacaagaacgattctgtttcgaacacagccacagaaataaaagatgaacaaaaatctgggacagtgcttcctgctgttgaacagtgtttaaacaggagtctctacagaccggatgctgttgcacagcctgtgacagaggatgagtttgctttggaatctgagattatttcaaaactatacatcccaaagagaaagattatttctccacgatctatagaagatgtgcttcctcctgttgaagaggctgttgacaggtgtctctacctactggaccgttttgcacaggctgtgacaaaggataagtttgctttggaatctgagaatatttcagaaccatactttacaaacagaaggactatttctcaacaatctgcagaaaagttgtcttctcagaaacaaccagctgagaaggctacaagtgacgacaaagattctgtttcaaatatagccacagaaataaaggagggaccaatatctgggacagtgtcttctcagaaacaaccagctgagaaggttatatttaaaaagaaagtttctcttttgaatattgccacaagaataacgggcggtgggaaatctggaacagtgtcttctcagaaacaaccaccctcaaaggctacaagtgacaagacagattctgctttgaatatagctacagaaataaaggatggactacaatgtgggacagtgtcttctcagaaacaaccagccttgaaggctacaactgacgaggaagattctgtttcgaatatagccacagaaataaaggatggagaaaaatctgggacagtgtcttctcagaaacaaccagccttgaaggctacaactgacgaggaagattctgttttgaatatagccacagaaataaaggatggagaaaaatctgagacagtgtcttctcagaaacaaccagccttgaaggctacaactgacgaggaagattctgtttcgattatagccacagaaataaaggacggagaaaaatctgggacagtgtcttctcggaaaaaaccagccttgaaggctacaagtgatgagaaagattctttttcgaatataaccagagaaaaaaaggatggagaaatatctaggacagtgtcttctcagaaaccaccagccttgaaggctacaagtgacgaggaagattctgttttgagtatagccagagaagaaaaggatggagaaaaatctaggacagtgtacttctgtcaccttctggtccccagagacaaagtagaagccatcaaagcctccactaatacaggcaggaggacagaggttgatgctaacaccgtgtgaatgtatggataactttatcatatttacatgtgagtgattatgtatcccttttgcttttcagtgtcttctcggaaaaaagcagccttgaaggctacaagtgatgagaaagattctttttcaaatataaccagagaaagaaaggatggagaaacatctaggacaggtaactttgcaaaacacatttaatgtcatgttcagtccagataagaagttctcttccccgaataaatcagtggggggctggtcgaaactgcacattctgattcagtaggcctgagattcttcatttctaataagttcttgggttatgctgatgctgctggtctggaacatgatcttcactgt

SEQ ID NO: 464174 - DNA, 1204 bp, Homo sapiens
agggcggtttctctgcctcgggcctgttgggcagggccggctaaggtgcgcgtgctcgctggttctaacccttctgttgggcgtttctgctgagaggcgggaggcgctgagagtctgtgcgaaggtccgtggacagactgctttgcctgttgttgctcttcggaggcggcgatccccgaaggcgagctgaaatacggctgcaggctacaatttgcagccgaccattatggatgacaaggagccgaagaggtggcccaccctcagggaccgcttgtgctcggatggcttcttatttccccaataccccattaaaccgtatcatctgaaggggatccacagagctgtcttctatcgtgatctggaggaactgaagttcgttctgctcacgcgttatgacatcaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcatatggtgcaaatattgaagaatgcagcgaggatgaatatccgccactgttccttgctgtgagtcaaagaaaagtgaaaatggtggaatttttattaaagaaaaaagcaaatataaatgccgttgattatcttggcagatcagccctcatacatgctgttactcttggagaaaaagatatagtcattcttcttctgcagcacaatattgatgtgttttctcgagatgtgtatggaaagcttgcagaagattatgccagcgaggctaagaacagagttgtcttctcagaaacaaccagccttgaaggctacaagtggcaaggaagattctatctcgaatatagccacagaaataaaggatggacaaaaatctgggacagtgtcttctcagaaacaaccggccttgaaggatacaagtgacaagaacgattctgtttcgaacacagccacagaaataaaagatgaacaaaaatctgggacagtgtcttctcagaaacaaccggtcttgaagaacactgggtaccg

SEQ ID NO: 464175 - DNA, 3420 bp, Homo sapiens
atcgggccgcctccagagccagagtaggctcagagactgcagcgcagctgcgtggtggaagaggatttatggacagaaaaaataaagtgacatacacaaaacagaagatcccaaagaagcaggccctgggacaaggatttggaattggcttggagttaattgaagggagcaacagtacagaagtagcaaatttagataggaaagtgagagggacaataaagggtgcattgacagttaagtcagtgcttgtgagtgctgaggttcgaaacattaattccccagaacttctggctgcctgccctgaacacaggcagaacaggctccaccggccagagaaagccctcagcaaagaattacaggtgctggaagttggaagtgttttaaataggcaccaaaatggcaatctcttcccatgttgtggaaaagacgtcaggccagtagcagacagtgctaggttcaggcttccaatattcttacaccaactttcccagtgaaaagaaaaaaaagaagccactttttcaaccactcaaatgaaattccagggaggattctgttgccttggtatccctacacctcttataccaacatggccagagagatggggttctctgatagctagagactggctcatctaactaccctgagttgaatttctcacaaggaagaactgttcagttagcagaaggaaagtgaaagaaagtgtaaagggaagccagaaattttatcttgcttagaagttaaagagtatgcacatgaaggtaaatatttgaaataggaattttgggctaatatggaaggacgtgtcttcattagagtttaatattagcaaacaaataacatacccaattgtttcagcagaaaatcactctgtacactgagtttggaggtcctcattcttgtaggttttgcatataatcacactctgtttatttcccctgaagttcatggaaacagaaatgtacatcatcattatgacacctgcaggatgcactcctaagagaagactacctgaaaggagtgtacactggtctagcagttgagatcagctagtgttccatctatcttctgtcatgtcagggaagactctctgatcctctcataatttacctattgttgatttcctgaatctttttaaatcctttgcaactgaagatggtctctccatcagagaagcaattaaccaaatgcctgactacagcgtatatagcatctgttataaaagcatgaaaggttaacttaaatcctggcacacaaaggagatgtcagaccagaacaaatcagcatggaaatacctggaggagatacaaggttaaggtggagcatatgtacagtcaagaggatgttcatgactagtggaatgtgtttttcagattgcaaagactggaaggtgcaggtgacaaggagattaaacaaggtcacttgttttctttccttctctgaaataaagaagaagtggccgtatcacacaatttcgacccatgggatataaatggaagtcgactgtgatttttcccagtcattgctttctgttaatgagatctgttttatttctcttttcttttttcgtcctactaaaaatgcatgtgattgtcatagctgaaacagccttgttacttcgaagagaaaactagcaaacatagtagctaggccatgtgatactgctgaactagtcatgaaaatggactaaaacactctggcttagggtaataacctgcaagttactcattccaattgaaaaatgagataagcatgaattatataaagtcatgtctaccattaatatttgataagaccattaagcatttttgcatcatatcatgcttagatttctcttaccaaagtctttgatccatttttcaatcacttccattttcttactaactaaagacaccaaactagaatgtctcttagtgcagggagtttgctttctccataggggatatggccattgggaagtacatctgttcttgctgtttgaggtttctttgttagcttattcctcccgcacaaccagtatcaattgtcccctgtgcatatactcacttcatttctgccaaattttgccagatgttagttgcgttactgagacaagaagatggccaatatccaaagtcccagatcaggtatctcctgccaatgctcaccttaatttctaggggatacaggtatacagaaaatccccctatatagcaactcacagtgacaatttcagtgtcaagccagttttatcctagtatgctgttatatttgcatataataaaggtgcctagcataatatctttgctgtctccaaacccaggattataatatttaagtctttttagtttattttccaatttttttcacatctatgcatctaagtgaaaataaatgtgatgggattgatgtaaatagcaaatgccattacatctagaccatgaatttctaattaaaaaagtcagaatgccaagaagagaaagttgtgtagatctcattgttttgagaagactagtaaaggacacagccagacagagatgagctttcagggggaagccaggagaataaatttgctttaattgctcccctttcttccccagatctcttctaagatgtcttgatcgactgaccccaaagccagagggtaccaggtcaaaaagcaaggtactaagggggttgggggtaaatttggaatacctgatagaagacatctcttattacttccctttcaaaattcagtcaatgaaaactcacccatgtttatgtgcctgttattgcactaaaactggatatacttcagtaaatgaagctgactcatagtctagtccatgggtcacctggtgggcagtgtagcattataaaatgaaaaagtgaaatcaataagtgctagtactagagggcaagaacatatgcagaataaataaacagaaatcacaaatgaagtattattctgttttgtttgtattttcacaacagatggttgaatgaaaaactccaataaccacagaagactgatttaataatggaatactatcagtaaagctcatttagaatctgtaattagatttcatccttgattatatgtgcaaatacctcctaagaaaataaccgtttaatagcttaattttggtttagaagccatttccagactttgaatctaatgttctaaatggtttctaaatttttgtgtagtatgatattctatgaaaacaatatgcattattaagttaaaacttattatttcttacattatttctaagaaaacaaacaatactgacattagagagaagcaaagtttctatagaaaacctattacactgtggtataaatcaagatgaacctgcagacatctattttaggtatgtattaaagttaatgtaataagactggcaccccaaatgctactattaaaagttttatatcaatgacaatgctattactact

SEQ ID NO: 464176 - DNA, 952 bp, Homo sapiens
ctttggagtctagctaacacagcatcttggatgcactcctaagagaagactacctgaaaggagtgtacactggtctagcagttgagatcagctagtgttccatctatcttctgtcatgtggaggagttcttgctctgtcacctagtctggaatgcaagggcacaatcatagctcactgcagcctcatactcctggactcaaatgatcctcctgcctcaccctcctgagtagttgggactacaggctatactggttattgtggatccaaaaatcctaggacacagactttgccctcaaattatttactgcatagtgggtggcctgaaaagcaaacataagcactaaatatggaaaaatgcaaaaggcaatgggaccataaaaggaacagatctcttctaagatgtcttgatcgactgaccccaaagccagagggtaccaggtcaaaaagcaagaaaacaaacaatactgacattagagagaagcaaagtttctatagaaaacctattacactgtggtataaatcaagatgaacctgcagacatctattttagtttggaagtctggaaaagttcaagattggccatctgcagctggtgagagcctcaggctgcttcccctcatggtggaaggtgaaggggagctggtgtgtgcagagattacatgcttttctaggtcatcattctaggctttgttgaagcatgcatttttggcatgagggtggcagcctttgcactatgtcatggctgaggagttaggatctggagggtgatgaaagcaaaggtgctgctggttactcttggttcatctagcaatagatgatctgaatgttagagttcgccaaatattgttcctgggcagtctttgctctaccaaatcaactttctccatgggggagctagaagtcaccccacattctccgccatggccagctctacattctaagaggtaaaaa

SEQ ID NO: 464177 - DNA, 654 bp, Homo sapiens
gagactttcttactataaatcgtaaatgttaaagactggccccaaagctaagccaaccaaccaccaattcatccattcagcgaacatttgccatacattaaccaagaggaatggtaaaaatcactgtgttctctgcaaagttttgattaatgggaaaaaggattttggtctcttcacacagatgcgtatgacatttggtgctgaagaccagggtcagagggactgcttcaagagaccagttccctgtcctcaccctcactctgtgaagagatccacctacaacctccggtcctcagaccaaccagcccaaggaacatctcaccaatttcaaatcagatggattctcgctctgttgcccaggctggagtccagtggcgccatctgcaagctccgcctcctgggttcacgccattctcctgcctcagcctccccagcagctgggactacaggcgcccgccaccatgcccggctaatttttggtatttttagtagagacggggtttcaccctgttagccaggatggtctccatctcctgacctcgtgatccacccgcctcggcctcccaaagtgctgggattacaggcgtgagccactgcgcccagcctaggtatttcaatagaagtggaataaagccaatttattgtctttgaaaa

SEQ ID NO: 464178 - DNA, 699 bp, Homo sapiens
gaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctggtctcttcacacagatgcgtatgacatttggtgctgaagaccagggtcagagggactgcttcaagagaccagttccctgtcctcaccctcactctgtgaagagatccacctacaacctccggtcctcagaccaaccagcccaaggaacatctcaccaatttcaaatcagatggattctcgctctgttgcccaggctggagtccagtggcgccatctgcaagctccgcctcctgggttcacgccattctcctgcctcagcctccccagcagctgggactacaggcgcccgccaccatgcccggctaatttttggtatttttagtagagacggggtttcaccctgttagccaggatggtctccatctcctgacctcgtgatccacccgcctcggcctcccaaagtgctgggattacaggcgtgagccactgcgcccagcctaggtatttcaatagaagtggaataaagccaatttattgtctttgaaaa

SEQ ID NO: 464179 - DNA, 1579 bp, Homo sapiens
  misc_feature (84)..(84): n is a, c, g, or t
tacccgagccttaacctttcatggaccagaaggattccagagctcttgccctaggtcctggggcagcgatgactcactgcagcnccccctcccacttcgccaagctgccgtctccgcccacccccaaacaatctcgacagcgcatttcgggagccacggctccgggcgctttgctgggggctaaaggggtttatccctttccttgaatcccagcaggctagaactaccccctcccagtcttcaggcttgcacgctctccacccgatccttccattgaaaggagagaaggaaggatgtgcttgggaactttaagacccacgaacgacagcgcactgatggagcagcccagtgtctggggcaaagtcctcgaggttcattcattcaggaagcctctgaccagcctttaccatgcgctgagtgagaagctgaggataaggaaagagcaagacccccaagaaaccctgatgtctggctgaaagccgaagcatgacgcaactttgctatatttctctccaacaaggatttgtatattttcgctttctcctcaagtaacacctggacctggtcctttcccctcaaacgctgagggctcagtctccaagttcctttatgaaacagggtgtaccatcagagacgcaggtattccccacatctgtaggagatggaagggagagaatcagagaaagaagagtcccaggcaagcaagaagctgcgggagaatatgcagcaataaattcaagtgccatttgctcttcaccaactctccggctcaggtatttattgaaacctgctttgtgctgggcaatgtgccagatgttggggataaaatgttggatctttttcatctacttcaatcaaaaccacgtatcacaacagactgaaggcagaacagatatgatcatcaagctgtcttctgttaatccagatgttaaatgtaaaacagtgctactctttgtactaaatgctttattttggaaaatatcattatttctcttaaaaatgtgctatttatgttaacataggagtttattgttatttttgagtgaataaagcaatatttttaaatttcttagttttaagattgaatacagtaaatattgataggtataatacatataaataaaactctttggggtccttaatactttttaggagtgtaaggggttcctgagagcaaaattttgaggatcctacctagtgcatgagaacatgggctctggagccaggcctgcctgggtatatcctattatcgctgggttttttttttaattttattttacgtttaggggtacatgtgcaggtttgttatgtagataataaactcatgtcatggggatttgttgtacagattattttgttacccagcctctgaaaggagtgtacttgcattgtatggacaaaggaagttactttgaaattattcctagctctgccatagatttgctctttggatttgaacttagatactttttagaatttgctcactctgatcaagtgttttgattatgaacgttagcagcaggcatccagttgcattcagctttccaagcaaatatttacagagccccttctgtgcaat

SEQ ID NO: 464180 - DNA, 832 bp, Homo sapiens
  misc_feature (84)..(84): n is a, c, g, or t
tacccgagccttaacctttcatggaccagaaggattccagagctcttgccctaggtcctggggcagcgatgactcactgcagcnccccctcccacttcgccaagctgccgtctccgcccacccccaaacaatctcgacagcgcatttcgggagccacggctccgggcgctttgctgggggctaaaggggtttatccctttccttgaatcccagcaggctagaactaccccctcccagtcttcaggcttgcacgctctccacccgatccttccattgaaaggagagaaggaaggatgtgcttgggaactttaagacccacgaacgacagcgcactgatggagcagcccagtgtctggggcaaagtcctcgaggttcattcattcaggaagcctctgaccagcctttaccatgcgctgagtgagaagctgaggataaggaaagagcaagacccccaagaaaccctgatgtctggctgaaagccgaagcatgacgcaactttgctatatttctctccaacaaggatttgtatattttcgctttctcctcaagtaacacctggacctggtcctttcccctcaaacgctgagggctcagtctccaagttcctttatgaaacagggtgtaccatcagagacgcaggtatttattgaaacctgctttgtgctgggcaatgtgccagatgttggggataaaatggtgagcagacagatcctgtgcctgtctttattgagcttggagcctagtatgtatgacaaactttaatcaaataatcatatattggaatattgcagctgcgtttcacttccaggtaccgagctgattgtatagctat

SEQ ID NO: 464181 - DNA, 1200 bp, Homo sapiens
  misc_feature (84)..(84): n is a, c, g, or t
tacccgagccttaacctttcatggaccagaaggattccagagctcttgccctaggtcctggggcagcgatgactcactgcagcnccccctcccacttcgccaagctgccgtctccgcccacccccaaacaatctcgacagcgcatttcgggagccacggctccgggcgctttgctgggggctaaaggggtttatccctttccttgaatcccagcaggctagaactaccccctcccagtcttcaggcttgcacgctctccacccgatccttccattgaaaggagagaaggaaggatgtgcttgggaactttaagacccacgaacgacagcgcactgatggagcagcccagtgtctggggcaaagtcctcgaggttcattcattcaggaagcctctgaccagcctttaccatgcgctgagtgagaagctgaggataaggaaagagcaagacccccaagaaaccctgatgtctggctgaaagccgaagcatgacgcaactttgctatatttctctccaacaaggatttgtatattttcgctttctcctcaagtaacacctggacctggtcctttcccctcaaacgctgagggctcagtctccaagttcctttatgaaacagggtgtaccatcagagacgcaggagacttcagaaatgaagatgcaaagacaacaggggaaaccatatatgtttatggacagtcatgccaaagtatgattggaagacaaaaagatttcttgcaatttcactgctcactaaacatctccatcaaagggtacctgggttggggcaccgccgtgtgggaaggcgaggaaggaaaccgacgaatcggcagtttccattaacctgtagacaactctggtaactaggttagtacggggaactgtcgacacatcagttattcagactattctgagctgtcaaccattgcttgttacaccctcctcccattagcatagactcggaagaatgcccctatttgactggcggaattgtgcctgcaccacgactgggtcatgcatatcggggcccttaaactgttgttcttcattggcactcccaccgaattcgcgggaaaggttctcttatcccagataaaatttacacttaggaagggcactaaccagacctttgggtgagacatttcctttgggggcaaaaattgggcccgacaaaatattacaacgactgtcctgttggtcg

SEQ ID NO: 464182 - DNA, 551 bp, Homo sapiens
acagcatcttcaggcagcaacaatcttcagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtctgcagattaaacaaatccgtcatgagtcgggagcttcgatcaaaattgatgagcctttagaaggattggaagattggatcattaccattagagaaacacaggaccagatacagaatgcacagtatttgctgcagaacagtgtgaagcagtgtgcagatgttgaaggagtataatgcaagatatttttttcttttttatagtgtgacgcagtattctggaaagtttttctaagactagtgaagaactac

SEQ ID NO: 464183 - DNA, 1290 bp, Homo sapiens
  misc_feature (2)..(2): n is a, c, g, or t
  misc_feature (7)..(8): n is a, c, g, or t
  misc_feature (11)..(12): n is a, c, g, or t
tntaaannatnnagaaacactgatgagatggttgaattacgcattctgcttcagaccaagaatgctggggcagtgattggaaaaggaggcaagaatatcaaggctctccgtacagactacaatgccagtgtttcagtcccagacagcagtggccccgagcacatattgagtatcagtgctggtattgacacaattggagaaattctgaagaaaatcatccctaccttggaagagggcctgcagtttccatcacccactgcaaccagccagctgccgctcgaatctgttgctgtggaatgcttaagttaccaacactataaaggaagtgactttgactgcgagttgaggctgttgattcatcagagtctagcaggaggaattattggggtcgaaggtgctaaaatcaaagaacttcgagagaacactcaaaccaccatcaagcttttccaggaatgctgtccttattccactgacaagagacgtgcacagccttatgatcccaatttttatgatgaaacctatgattatggtggttttacaattatgtttgatgaccgctgtggacgcccagtgggatttcccatgcggggaagaggtggttttgacagaatgcctcctggtcagggtgggcgtcccatgcctccatctagaagagattatgatgatatgagccctcgtcaaggaccacctccacctcctccaggacaaggtggtgagggtggtagcagagctcggaatcttcctcttcctcctccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtctgcagattaaacaaatccgtcatgagtcgggagcttcgatcaaaattgatgagcctttagaaggattggaagattggatcattaccattagagaaacacaggaccagatacagaatgcacagtatttgctgcagaacagtgtgaagcagtgtgcagatgttgaaggagtataatgcaagatatttttttcttttttatagtgtgacgcagtattctggaaagtttttctaagactagtgaagaactac

SEQ ID NO: 464184 - DNA, 785 bp, Homo sapiens
tttttttttaatttgtattgctatttattaaaatattaatatttacataatttattgatataatattcaattgtttgataggtaattaatacattccgactcacccagcaagaacatttttgtggtgacaaggtaaagagtaggatgacaattggatgacccaaaacttagacctcagtaagtgaaaaacgtgttgttatcaatgctcctaacttgtatcattatctaacaagattttccaggcagtggcagctttagaatcctatcttctctcagtttccttttcctagtagctgccagttaggatgccaaccatccctgattttatgtaggatgatgatagccaggggcaaatgaggaagactcacagaaatctaggactaaatataagaattttaaaaatgggagatttttatggtaaagaatgtgaggtttgtagttttttaatctccacaggagaaatgaacaaatgattccatgtaagaacactggaagatactaaattccaccttgatattttccaggaatgtcagtcacatcctcagtcttggttgacttcctgaaagtgtcctctccagtcttgagggacctcctgctccaggaagcctgccctgatgtcccagccagagatggtcctctgaatttcccctggccttcacctggcttctctgggagcacagtcacaattcattgtatattatcactaattggatacttatttcatgtcctgtgttcacagtggtaactagcatgtatacattacttatagtttgataacagccttt

SEQ ID NO: 464185 - DNA, 829 bp, Homo sapiens
tcctttatttagaataactgtgttattttgttgttgtgaggtctaggtaattaatacattccgactcacccagcaagaacatttttgtggtgacaaggtaaagagtaggatgacaattggatgacccaaaacttagacctcactttccttcccagaatgcagatgctatcctggagggcgagctgcccaaatgggatgtggaggcagcagcatgacgacaaaagatgcaatctgaagctggtggagccacaggacgggagctggacagtgagggtttcatggaggccgtgcacaggactgcccccatctgcagggacactgtggttattcagtcttgctgtgcacctaagggcagttgccaagcggtggcagctacaaagctggggaggggctctgtgaaccagggcctcctatggctcctgttgggtttgggccaatgggaggctccaagatacacctcagcctcgcactcttggctcccattcttggtgggtacaggttccccccgccttgtgtctgcaggcctagcactgggaacgacttccttctgagctactttctgagtgcttccaccccttcctggcttccttaatcctacctgcgcctctccaaagggtcccttcattcaattatcttcagtttaaccctttgagctgccatccatttgctgcacacagggacaggtggctcactgcttcacaggcagcaaccatacaactgtggcttgtcttcctacgtcttctgcatctgaaataacaaagaacttccatcagggctcagtgtcaggcagaattaatttcaagtctctattttatttacttcctgcagg

SEQ ID NO: 464186 - DNA, 503 bp, Homo sapiens
tttttttttaatttgtattgctatttattaaaatattaatatttacataatttattgatataatattcaattgtttgataggtaattaatacattccgactcacccagcaagaacatttttgtggtgacaaggtaaagagtaggatgacaattggatgacccaaaacttagacctcagtaagtgaaaaacgtgttgttatcaatgctcctaacttgtatcattatctaacaagattttccaggcagtggcagctttagaatcctatcttctctcagtttccttttcctagtagctgccagttaggatgccaaccatccctgattttatgtaggatgatgatagccaggggcaaacttggtactctgacccgagtcttagggtaaatataaaaatttcccgaatgttattttcttctaaggaaaagggaggggccataattttaaatccaaattccccaaaccccaaaggactcccaatccactcggtttttaaaattacccca

SEQ ID NO: 464187 - DNA, 1222 bp, Homo sapiens
tccaaggttaatcagtgggtgagaagcaggtgcaggaccccaggctattctgttcacaagggtagtgcttttttcatcagacaacacacatctctatggcagtgtccaaatggtgcctaacgtagaagcaagcttaaatgtgtctgactgcggccatcttggctccctcaaggccaccaaagcaagtcctgtggttgcttccttttgctattgcgaagccccttcagagtctactttgtcctactgcagtagcagtgaggcccgtccatcagggatgctgggctatgaaccgggcttcttgtcttgcagccacttccatcatcccagggatacaagttactccaaacctagcttccctgcaattccatttcccacaccaaaacatggaaaggataatgctgacatcccaccagggcctgtggggacaaccgattttgttgtaattaatacattccgactcacccagcaagaacatttttgtggtgacaaggtaaagagtaggatgacaattggatgacccaaaacttagacctcactttccttcccagaatgcagatgctatcctggagggcgagctgcccaaatgggatgtggaggcagcagcatgacgacaaaagatgcaatctgaagctggtggagccacaggacgggagctggacagtgagggtttcatggaggccgtgcacaggactgcccccatctgcagggacactgtggttattcagtcttgctgtgcacctaagggcagttgccaagcggtggcagctacaaagctggggaggggctctgtgaaccagggcctcctatggctcctgttgggtttgggccaatgggaggctccaagatacacctcagcctcgcactcttggctcccattcttggtgggtacaggttccccccgccttgtgtctgcaggcctagcactgggaacgacttccttctgagctactttctgagtgcttccaccccttcctggcttccttaatcctacctgcgcctctccaaagggtcccttcattcaattatcttcagtttaaccctttgagctgccatccatttgctgcacacagggacaggtggctcactgcttcacaggcagcaaccatacaactgtggcttgtcttcctacgtcttctgcatctgaaataacaaagaacttccatcagggctcagtgtcaggcagaattaatttcaagtctctattttatttacttcctgcagg

SEQ ID NO: 464188 - DNA, 731 bp, Homo sapiens
tactctaagcactaaccgcttcctcctccaccttcccttctcagctttccttcccagaatgcagatgctatcctggagggcgagctgcccaaatgggatgtggaggcagcagcatgacgacaaaagatgcaatctgaagctggtggagccacaggacgggagctggacagtgagggtttcatggaggccgtgcacaggactgcccccatctgcagggacactgtggttattcagtcttgctgtgcacctaagggcagttgccaagcggtggcagctacaaagctggggaggggctctgtgaaccagggcctcctatggctcctgttgggtttgggccaatgggaggctccaagatacacctcagcctcgcactcttggctcccattcttggtgggtacaggttccccccgccttgtgtctgcaggcctagcactgggaacgacttccttctgagctactttctgagtgcttccaccccttcctggcttccttaatcctacctgcgcctctccaaagggtcccttcattcaattatcttcagtttaaccctttgagctgccatccatttgctgcacacagggacaggtggctcactgcttcacaggcagcaaccatacaactgtggcttgtcttcctacgtcttctgcatctgaaataacaaagaacttccatcagggctcagtgtcaggcagaattaatttcaagtctctattttatttacttcctgcagg

SEQ ID NO: 464189 - DNA, 2858 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464190 - DNA, 2975 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctgggccatctctcctggttggtcctggtgcgacagctgccctgtcactccttggggtgtagcctccatcttccgctccctttgccctgcagaggggcccagcagctctcctccctgcaggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464191 - DNA, 2305 bp, Homo sapiens
tggctaggtagaggctgggtgttgaatcggccgagggtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464192 - DNA, 2891 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtgaaaaaaaaaaaagtcgacgcggccgcgaatttag

SEQ ID NO: 464193 - DNA, 2063 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctgcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464194 - DNA, 1933 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctcttccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464195 - DNA, 1571 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464196 - DNA, 962 bp, Homo sapiens
catccgtgtggccagcaccaaccctgctgtgcaggcctttgacatctggtaagagtgtggtgcctgtggggctgcggagggcacatggcaggccagagccaggctctggcgccacgacccctgggaggtgctgggtgtagctggtgtggactccaacactcctgggcttgtgtgacaccaggcaaggtgtccacaagacaccagtcactgagccctcccgcatagccctccctcgggtccccctgcactcttggcctccccttccactccctggagccacctcccccagattcgtggggagcactcaggacagtgcagccctcaggctggacagctgccttgctcctaggtccgccccgtgcccaggctgggctgtctggcactgggtccgtgggctctggccttagggccatctctcctggttggtcctggtgcgacagctgccctgtcactccttggggtgtagcctccatcttccgctccctttgccctgcagaggggcccagcagctctcctccctgcaggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggtggggggcctgggccagggccgggtggatgggtgggtgcccacgggtgtctgcctgggctcctggtgacgctccacctgcccgcaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgt

SEQ ID NO: 464197 - DNA, 2387 bp, Homo sapiens
accctgggagctgaccctggaacccgggcagagggccaggtccagggctgtcggggggtggacagcggcctgccactcactttcccctgaggctcaccctgtcctttgcaggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctgggccatctctcctggttggtcctggtgcgacagctgccctgtcactccttggggtgtagcctccatcttccgctccctttgccctgcagaggggcccagcagctctcctccctgcaggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtgatgtactgtgttttgtgttgcccgatattaaaaccaaacttttgtcat

SEQ ID NO: 464198 - DNA, 2698 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464199 - DNA, 2223 bp, Homo sapiens
accctgggagctgaccctggaacccgggcagagggccaggtccagggctgtcggggggtggacagcggcctgccactcactttcccctgaggctcaccctgtcctttgcaggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464200 - DNA, 2905 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtgatgtactgtgttttgtgttgcccgatattaaaaccaaacttttgtcat

SEQ ID NO: 464201 - DNA, 2093 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactacgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctcttccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 464202 - DNA, 971 bp, Homo sapiens
accccccgctcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggtgaggctgctcgggccggccggccgcatcctctcctgcgcagggcttgctgggaggtcaggaggaggcctccgccagctccccgaggccccgaaagcgcctgggcgcagctggggagaggcgccggtcctcatccagagggaccgcggcgtgggctgagcgcgcttaggggtgccgccggcactgacttgcaggtgacgggaacccaagttcagaaccttgggc

SEQ ID NO: 464203 - DNA, 420 bp, Homo sapiens
  misc_feature (21)..(21): n is a, c, g, or t
  misc_feature (23)..(23): n is a, c, g, or t
cctatttccgagtagaaagtngntttaaacctgaagtgtaagagaaagattatgcccctaaatgatttttttttcctcctaatgtattagggcaaaatccctcaatgatgatacctgctcctcaaagaatataaaattgatgagaaaaactttgtggtggttatggtgacccaaagtaagtttcaacctcattctgtatatctttatgcatgtaggtctttttaaaaatgatgatcacaagtccacacaatggacacagtttatacacatccatagtggtgtacacttaactactatgaaaggtttttaagaatttaccttaagtgaaacataaagttattaatgttttacattaattacacattaaactataatatagttttaataaaattttatgtaaattaaaacaaaagaaaaaaa

SEQ ID NO: 464204 - DNA, 1312 bp, Homo sapiens
gaggccgcagaccctgcccagcagccagcacctggcacaggccctgcagccgagctgtacagtggcaccatgcaggtcaccctgaagaccctccagccgcagaccttgacctgcaagatagacattgaccccgaggagacagtgaaagcactgaaagagaagacggaatctgaaaaggggaaagttgcctctctggtagcaggtcaaacattaatttatgcaggcaaaatccctcaatgatgatacctgctcctcaaagaatataaaattgatgagaaaaactttgtggtggttatggtgaccgaacccaaagcagtgtccacaccagcactagctacaactcagcagtcagctcctgccagcactacagcagttacttcctccacaacaacaactgtggctcaggctccaacccctgtccctgctttggctccccctttcacacctgcattcatcactccagtatcagtgacagtgtcctctgaacctgcaactgctagtgcaactaaacaagagaaacctgcagaaaagccagcagagacaccagtggctactagcctgacatcaactcatagtacatcaggagattcttcttggtcaaacctttttgaagatgcaacgagtgcacttgtgatgggtcagtcttacgataatatggtaactgagatcatgtcaatgggctatgaacgagagcaagtaattgcagccccaagagccagttccaacaaccctgacagggcagtggagtaccttttaatgggaatccctggagataaagtcaggttgtggttgacccccaccaagcagctagtactggggctcctcagtcttcaacagtggctgcagctgcagcaactacgacagcaacaactacagcaacctggcttcccaagagtggcttgcaaaaactacctttacatttttactgaattcactcttcaacaagttctagaatggcatctacgcctgccaattcacaaaaactgcttttgtaagaccatcaacaaccttcatggtaccaatttcaaagatccattttctgaccttatctttattgaccatctaacggcatctagtgatatctttaatgaaataagacccaattctctaaaattggctgatgcaaagaatctccaaatgggagagaggcggttgtgcctgtaaacttctctccattcccaagatgcatatttatttcctttgggagacttcccagtaaccatatgccacacagaagcccctgttccttctcttctctaacttctagttcagatgtggtggacttatctctcagtactcttaattcagatgt

SEQ ID NO: 464205 - DNA, 1038 bp, Homo sapiens
gctctcctccctcctctggcctctaggctcccaggactggtttggaacccgcgccatgtgctctggaggctgtggcagggcaggcaaagggcctctgagggagtattacagccgcctcatccaccagaagcatttccagcacatccaggtctgcatcccctggctggagggccgaggactacccccgcttctagtttacatgagctggtgaaacatgaagaaaaccgcctggtctttgaggactcagaggaactggcagctcagctgcagagccaagagctgggtagagctgcaaggacaccgcctgcacaggatgcccggggctgggcattacctgctgtaatgacaacatctggctggaaggcagagagctgatggaccgtcgctacgtcccagtccagctgggccactgtcaccctggggctatctaagttggcagtgatgtctgcctctaatgagaggccattgagaaggacattccctcggagctgctcgaggacccggctgtgacagtcgctgaagatgtatgtccgggggtggcacatcttgcagatggacaggcctgtaaggccggcgccactgccaagctctaggacagtcctggcgggaggaaaggggaccgtgttttcgactgcaccagggtaagcctgcctcggtgccctgccctgtgccccgaggtcacctgttagtgaaggctgccaggttctcaatgacccattctgcaaggtagatggcggctgccctgtgccccgaggtcacctgttagtgaaggctgccaggttcttgatggcccattctgcaaggtagcgggcagcgtcccatgtgaccaggcctgtggtaccgtgggagatgatggctgtgctcggagagtgtgaccgagccttccgagggctgtaccaagagagggtgagacagtcttccggagagattcaggaggcagggtcatgagtcccagggactctggaattcttaccttctgcaaaatatcccgcagcagctcagaatctgatgagtctcttaattttgcttctaagctcc

SEQ ID NO: 464206 - DNA, 1680 bp, Homo sapiens
ccaacagagctcgacaaacagacaggagggtggaagggcaccgccttccaccccacccgcttagacagcctttcaactctgcccactttgaggatctgtaggatgatccaggtgggaggtgacaccaggaggtaaccaggtggaaatcaccctcaagtagcagagacaggtgtgcaaaggctcagagggagcttctccaggatcagcagagctcgattgtagggtgtgaggctgtcacagaggctggagaaataagcagttccttgctaagaagtctgaattttaacctgaagggacatgggagctactgcaggctgggctgtgaccgtctacgacaagccggcatctttctttaaagaggcacctctggacctgcagcaccggctcttcatgaagctgggcagcacgcactctccgttcagggcccgctcagaacctgaggacccagacacagagcggtcggccttcacggagcgggattctgggagcgggctggtgacgcgtctccacgagcggccagccctgctggtcagcagcacaagctggacagagtttgaacaactgactcttgacggacagaaccttccttctctcgtctgtgtgataacaggcaaagggcctctgagggagtattacagccgcctcatccaccagaagcatttccagcacatccaggtctgcatcccctggctggagggccgaggactacccccgcttctagggtcggtggacctggatgtctgtctggacacgtcctccagtggcctggacctgcccatgaaggtggtggacatgttcaggtgctgtttgcctgcgtgtgccgtgaacttcaagtgtttacatgagctggtgaaacatgaagaaaaccgcctggtctttgaggactcagaggaactggcagctcagctgcagagccaagagctgggtagagctgcaaggacaccgcctgcacaggatgcccggggctgggcattacctgctgtaatgacaacatctggctggaaggcagagagctgatggaccgtcgctacgtcccagtccagctgggccactgtcaccctggggctatctaagttggcagtgatgtctgcctctaatgagaggccattgagaaggacattccctcggagctgctcgaggacccggctgtgacagtcgctgaagatgtatgtccgggggtggcacatcttgcagatggacaggcctgtaaggccggcgccactgccaagctctaggacagtcctggcgggaggaaaggggaccgtgttttcgactgcaccagggtaagcctgcctcggtgccctgccctgtgccccgaggtcacctgttagtgaaggctgccaggttctcaatgacccattctgcaaggtagatggcggctgccctgtgccccgaggtcacctgttagtgaaggctgccaggttcttgatggcccattctgcaaggtagcgggcagcgtcccatgtgaccaggcctgtggtaccgtgggagatgatggctgtgctcggagagtgtgaccgagccttccgagggctgtaccaagagagggtgagacagtcttccggagagattcaggaggcagggtcatgagtcccagggactctggaattcttaccttctgcaaaatatcccgcagcagctcagaatctgatgagtctcttaattttgcttctaagctcc

SEQ ID NO: 464207 - DNA, 2043 bp, Homo sapiens
agcatctgcctcaggtgccagaatgcccactacctgctgctcggggaccactgtgttcctgactgcccttcaggatactatgcagagagaggagcttgtaaaaaatgccactcctcctgcagaacctgccagggcagaggacctttctcctgctcctcatgtgacaccaacctcgtgctgtcccacactggcacctgcagcaccacctgcttccctgggcactatcttgatgacaatcatgtttgccagcagccaatggagtattgaagtaggagtggatgaccatttcttagacctacagcagaaaacaagtctgtttaagaaggtgattgaacccccacactcatgcaacacacactgtggaagctgtgattcacaggccagctgtacctcctgccgagatccaaacaaggttctgctctttggggaatgtcaatacgagagctgcgccccacagtactatcttgacttctccaccaacacgtgcaaaggagataatgtcaaatgccaagtgcctttttctttgctctccagtagttggaattctcggggcttacacactttgaatggtagtgctcagcaacaggaaagcaaagctgcagacagagtcctcataaatgaactgctgggtctgagggtggacagaaaggaagataatctaatgcagactttctttttagagtgtgattggagctgcagtgcatgcagtgggcccctgaaaacagactgcctgcagtgcatggatggctatgttctccaggatggggcctgcgtggagcagtgcttgtcatcattttaccaggactcgggcctctgcaagaactgtgacagctactgtctccagtgccaaggtccccatgagtgtacccgctgcaaagggccatttctcctcttggaagcccagtgtgtccaggaatgtgggaaggggtactttgcagatcatgcaaagcacaaatgcacagcctgccctcaggggtgcttgcagtgcagccacagggaccgttgtcacctctgtgaccatgggttctttctgaagagtggcctctgtgtttacaactgtgttcctggcttttctgtccacacctctaatgaaacatgttctggcaaaatacacacccctagtcttcatgtgaatggttccctgatcctcccaattggttcaataaagccactggatttttccctcctgaatgtccaagaccaggagggtagggtcgaagatctcctatttcatgttgtgagcactcccaccaatggtcagctagtgctctcaagaaatggaaaagaggttcagctggacaaggctggccgttttagctggaaagatgtgaacgagaagaaagccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcaggtgaagaacaagcagtacaaacagattgctggtgatggtggtgtttagatttagatttccttgcctcagttccaataaagtttaaagaatgaaggaggagaaaacatgataagttatttagcagtgtaaatactggtacatgttcacaaaataatgatgattggtaacagagcttcatgaccagcttcatgatcagattcaaatcccagctcatcaacttaacatttgtgtaacttctaacgttattaaactctgaacctgaagaccttcatctgtaaaatgaagacaataatggcatcattcagaataattaaatagaattaatagaagtgtattagtctgttttcacactgctgataaaggcatacctaaga

SEQ ID NO: 464208 - DNA, 1191 bp, Homo sapiens
ccgaagctgctggcaagtaggccacctgagaaagacgtcaaaatgtcctcatcgtgctctggagaattcccttccggttttagcatggtacccacagattcacctcctggtggtgatgcttgtcagctacaaaggcagggcacagaatatgtgatatttcagagagaaatcaagctacttggtttgaggaaactcaacaaaattcaagataacacagagaaggaattcagaatgctatcagataaatttaaccaagagattgaaataattaaaaaagaaggagaaattctggagttgaaaaattcaactgacatactgaagaatgcatcaggatcttttaacaacagaataggtcaagcaaaagaaagaattggtgaacttgaagacagcctatttgaaaatacacagtcagatgagacaaaagaaaataaattttctaaatcttctaggtgtgtttcactcttttttacttatataaaagcaaaaacttatataaacatgaaggagaagactttctcagacaaacaaaagctgagagataacaccagacctgtcttacaagaaatgctaaaggaagttagaaaagaaagttaatgagcaataagaaatcaactgaaggtgcaaaactcactggtaataatgaaatgtagaccttttcatcatgtactcctaacatggcagctgccttcctcaaaaaagaagagagagagaacaagagagagtgaccaagatggccatcacagactttttgtaacctaatcttggaagtgacaccccattccctctgctgcattatcttctctagaagaacttatgttctggttcaggaggcagaactattgaaatgtgatcagtgctataaaagctgtaggagttgtgggagcagaaaaactttttaagatgaagtgaagcttgggcttgtgttgaagaaaagaataggagagaaagcatctgccgacatgtacctgtgagaaccttgcaagaattacagacacttttaatgacaaaaccaggcatctgcattgggaggagtggtaaggaagaaggaggctggataaaggagctagaagccatgctgggagggtcctattaggccacactcaggactttggaatctgcagtacgtggagtggaaacactgaaggatataatcagttatgtacagaataaagaatgttctgagccaagctc

SEQ ID NO: 464209 - DNA, 817 bp, Homo sapiens
aaatattgtcagtaatgctagacatgatgaattggtgtaaccaaattatttctgaatttgactttattttgcggattttccttgcaaatgttcagcctgggcctttgagaaaactgcataaatataatctttggtgctcccaacttccatgcattttacctattggtttgactgtgattttaagaagtcttactaagtatccagcattacccttgggtctgtatgacacaaattttgatttaagaaactcaattatctgggaaactcaggacatctcaggttctggaaaattgcctcaagggattaaccggtttaatgggggaaggatggatccaagggcttcaaatgtgcttcacagacaaggaaaaaatctcccagttggccgctcctggattccttagctcggaactccagacacatattcagacatggcctagtacagatatgttctacaactggaaaaaaatggttatgattgaggcttagaagtggagtgcagtgaagaaactttagggaagcctgacaaccacaccctctgctgatccctgtggaattttacatggataatgagtaaaagactgtcctgccaatagagaatacagtgaaacggtatggaacatacacagtggaacagaggacactgatggaacagtgtttataagcacaaagtttggaagtacggaatcctagataaaatcctgactgtggaattaactgcgtgaccttcggcaaattacttcatctctttgagcctcagtgtcttcacatataaaatgagaataataaaagcccttatctcatagtatttctgaaaggg

SEQ ID NO: 464210 - DNA, 917 bp, Homo sapiens
gctgcaatccgtagaggaacccgccgccgagccaccatcatgcctgggcacttacaggaaggcttcggctgtgtggtcaccaaccgattcgaccagttatttgacgacgaatcggaccccttcgaggtgctgaaggcagcggagaacaagaaaaaagaagccggcaggggtggcgttgggggccctggggccaagagcgcagctcaggcggcggcccagaccaactccaacgcggcaggcaaacagctgcgcaaggagtcccagaaagaccgcaagaacccgctgccccgcagcgttggcgtggttgacaagaaagaggagacgcagccgcccgtggcgcttaagaaagaaggaataagacgagttggaagaagacctgatcaacaacttcaggttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgacgaaacacctgaaggtgaagaacatcatccagtggcagacactgaaaataaggagaatgatgttgaagaggtaaaagaggagggtccaaaagagatgactttggatgagtggaaggctattcaaaataaggaccgggcaaaagtagaatttaatatctgaaaaccaaatgaaggtgctgatgggcagtggaagaagggatttgttttcataaatcaaagagtgaagaggcttatgctgagtattcagttatggagatc

SEQ ID NO: 464211 - DNA, 632 bp, Homo sapiens
agaatgaggaaaggtggtgagagagagggcacatcaaagacaatagtgctcagagcagcttttacttattgaatgcctgctatatactggataaacctggtttatacaacatctgccttctccaaattttatgagcagtctgttgttgcagatgtcagcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgctgggcttcggtcggattactcgtcaaccataggatctgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacaggtacgatgcagg

SEQ ID NO: 464212 - DNA, 1358 bp, Homo sapiens
agaatgaggaaaggtggtgagagagagggcacatcaaagacaatagtgctcagagcagcttttacttattgaatgcctgctatatactggataaacctggtttatacaacatctgccttctccaaattttatgagcagtctgttgttgcagatgtcagcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgctgggcttcggtcggattactcgtcaaccataggatctggtaaattctttcatgtggttccccctccccccatgttaatattgtttttggctgtaattttcattttctaattgatggtatttgttagtgctcttttaattgcaagtgacagaaatgcattcaaactgccttaagcacaaaagaaacttgactggctcatgtaagtgggacatacatggagtgtgctggcgttagttatggttgagtctaggatctaaaataaaaatatcatcagaactctgcatctctgcctacttctatggagccttctttatcaagtgtgctcttccactgtatttgtaacaaggaccaccaagcagatccaaacttataatttatcattttctaaaccatgatgaaaaccacctccacgtatttcctgattgctcttgcagaagtcctggggctgactctcattgtctggattgactgacatgcctattcttgaaatgacttctttgactctgattggccagcctgggttatgtgcccacctctgaaactaggggtgagtttaaccccaaccaaactatatagacagagtgtggatagtttctaaaggcaaaatgctgggctgttaccagaaggcagggaagtggacctaggctggccatatgtccttcacatgacctcttttgccctttacttttctataaagatttctgtttttataaaagtcattcctaaaaaaaaagaaaagaaaggaaaatggtgctgtctccacagacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacaggtacgatgcagg

SEQ ID NO: 464213 - DNA, 1848 bp, Homo sapiens
  misc_feature (4)..(4): n is a, c, g, or t
  misc_feature (8)..(8): n is a, c, g, or t
  misc_feature (10)..(11): n is a, c, g, or t
  misc_feature (13)..(14): n is a, c, g, or t
gggngtgncnncnnggtggttgtctctgctttttgaaaaagaagtccccgcccgacccccgccccgccaggcgctggtctgagcgtctgagcccagatggtgcgcttgctccagagggcgggcggctccagtggcccgcgggacggtggggccagagggccgtgggggtgggggagccgcccgcaggagaaggagccccgcccgcgccggccctggagtcgccggtgtcgccgccctgcccgcgggccgccctcctggcccagcccagggccctgcgagctattttgaaagtgaccctgggctggggcgccgggggagcgcggcgcgcaaaaccatgacagaagatgaccgaggcggcgctggtggagggccaggtcaagctgcgggacggcaagaaggtggctggtgctgcggaacgcgtcgcccgtggcagagtgagcggggcgggcgggggacggcggggcgcgggggtagcgacacgggttaccgaggcccggggcagtaatgccagcttgcccaaaatcgccgccgctgtcaccccgccgggaaacccgagagccccgtgcggacccggaccccccggcgcccctgggagcgcagactgcctgctgatgctggtctacaaggacaagtcggagcgtatcaagggcctgcgggagcgcagcagcctgacgctagaggacatctgcgggctggagcccggcctgccctacgagggcctggtccacacgctggccattgtctgcctgtcccaggccatcatgctgggctttgacagccacgaggccatgtgtgcgtgggatgcccggatccgctatgcgctcggcgagggggctggcgtcttcttcctgtcctcggccgagggggagcagatcagcttcctgttcgactgcatcgtccgaggcatctcccccaccaagggcccctttggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccaacaaccggctcaccgcatggccagagcaatcctcgtcgtcagccagcacgtcacaggaggggcctagaccagcagctgcccaggccgccggggaagccatggtgggtgcctcaaggcaccccccaagccgctgcgtccgcggagtgcaggaggttggccgccagagctcctcggacagcggcatcgcactggcagccactcctcttactccagcagcctctcgtcctacgcgggcacagcctggacgtgtggcgggccaagatgaactgggctcactgctcagcctgccagcagcgggggcccccgagccagcctgtgcacctgcctgcccgggacagtcgagtaccaggtgcccacctccctgcgggcccactatgacacaccacgcagcctttgcctggctcctagagaccacagccccccctcacagggcagccccgacaacagtgcggccagggactcaggcggccagacagcaggagcctctgccctagaccaccccctctgttcagcaggcccaggctggtccctctcggcacccgtgccacaggaagcctggagcgtccgggacgaggcgaggcccgtgcagacccgatggcaccgcacactcacgccccacacacggatgggacctgggctcagcccagctaccagcagctcacatgtggggtgtggggacctcgccgtccccatgtcccaagcagccaaacgctggcac

SEQ ID NO: 464214 - DNA, 4889 bp, Homo sapiens
tgtgatcaattcaggactcttccactgaagagatgtgaagtttcttgggttatgctgatgctgctggtctggaacatgatctttgctgtaagattatacacatccccacattgcaattgggaggaagaaatatggagagcagttgaagacgctacaagtgacgaggaagattctgttttgaatatagccagagaaaaaaaggatggagaaaaatctagaacagtgtcttctcggaaaaaagcagccttgaaggctacaagtgacgagaaagattctgttttgaatatagccagaggaaaaaagcatggagaaaaaactaggagagtgtcttctcataaacaaccagccttgaaggctacaagtgacaaggaaaattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaactggcctggaaggctacaagtgtcaagaaagattctgtttcgaatatagccacagagataaaggatggacaaatacgtgggacagtgtcttctcagagacaaccagccttgaaggctacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggttggaaatctggaacagagtatcctgagaatctgcccaccttgaaggctacaattgaaaataaaaattctgttctgaatacagccaccaaaatgaaagatgtacaaacatccacaccagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgagatttgccatacagcaagaaaaaaagaaaagaagaaatgttgaagagttgcaccaaaaagttagggaaaagttaagaatcacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatgaggaaacattagcagaaacgatagcctgttatagtggacagcttgctgctctgacggatgaaaacacaacgctccgttctaaactggagaagcaaagagagagcgggcaaagactggaaacagaaatgcaatcataccgttgtagactgaatgctgctctatgtgatcatgatcaaagtcactcatcaaaaagagaccaagagcttgctttccagggcacagtagataaatgttgtcatttacaggaaaatttgaattctcatgttctgattctttctctgcaactttctaaagctgagagtaagttcagagtcctcgaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaagcaggaaagattttgtcaactaaaaaaacaaaatatgttgcttcaacagcaactggatgatgctcgcaacaaagctgacaatcaagaaaaagcaatacttaatattcaagccagatgtgatgctagagtagaaaaccttcaagctgagtgcagaaagcaccgtctcttactagaagaagacaataaaatgttggtgaatgaattgaatcattcgaaagaaaaaaaatgccaatatgaaaaagagaaagcagaaagagaagtagctgtgagacagcttcaacaaaaacaagatgatgtcttaaacaaacgatcagcaacaaaagctttgctggatgcttcatcgcgtcactgcatctatttagaaaatgggatgcaggattcaaggaagaaattagaccagatgagaagtcaagtatgtatgcaactttgcacaccaacaactgttaatctgtagctagttaactaatataaagtgttttggggtactaattttagtggatggctttcttttgtatttttatgataattaatgttattaaaattttatagtggatggctttcttctgtattttccttattattaattttattaagattttattataatgcacctatatcttaatctctggctttcattctgccattttttatacatatatttttttcttaaatatttaaccttaggaaagttgagaattatgcatcatttctcacagaaattgagagagtttttttcctgttaaacgtctatttttaatgatttctctattggcatggtgaggcaagccagattaattcagaggataatgtctaatggaatgtttcagaaaattatcttctttttagtctctacttttctgaatgtataaagaacctgtgtatacttatttcatagatttcaggttaatttgttcagaaaggccattttactgaataaatttttatttcgatgaaaatcgttactccttttgtattgggctcagagagcacactctgtctctatatgaatatggacagttcgcatttgccaacatgtatctattttctcttatttgtagaaaaagctaaactaaaaagggggttatagaaggtcagcaaaggatgggtttgagatgtttgggttggttaagtgggcatttagacaacagggcttctcctttggcatgtttaatggacacctttgcagtttaagatgatgcttttaaattacttctctcctaatgatgacctgagtcctgctattcaatgggagagtcaataatatcctgtaggatcttatttggaactgactttgtcgattttaattttgttcctgcttgtttttaaattttcttgttgtttccctagaaagaaaagatgacgcttagttttaaatatttaaaaatgtgcaagttgctttgctataataaaactaaatgcatacatacaaaaaataaaattatagttgatgtggtagtgtttggaattcaaaatataaatgcttagcctgatgtaatcctttatctttccacattttaccagtttgtagaaaaatgacacagtagcccaatcgtctacttttgtgattgctaagaatttgtgtaattataccttcagaagtttgtttagaatttacatgatttaaaaacaattatgtgtgagagtaattattttaaaatgcacattttaggcttgaagtagaaaatgtcatgatgagaaaaattattaaaaaacaggatgaacaaattgagcggtttgagaaaatcctgcagcattcaagtttgattttggaatatttgcatatacctaatgaaatatcttgcggatggtacctgagtctaaacatgaaattcatttatgtttcatatataccttatgcacatagcctgaaggtaattctctacaatgttttacagtaattttttgcagaaactgatattatatgaaagttgggttgtttgattgagtcccataattgccatatgcatttgttattcttttttgttgttgtttttcccctgatggaatcatttcaaatgttttttctgtaagctcactgattctttttttctgctaataaaatcagctgctgaagcattgtattaaatttttagtttgttgtattctctatatctagaatttctatttgttttttgttatcatatctatttctacttcagaactatcattctgttaatgaattttttcccaaatttattttagtatgttatccatattttcttgtacaggcatacttcagggatattgcaggtgtggttccaggcaaccacaatgtaacaagaacttgaatttttggttttacactgcatataaaagttttttatactataccatagtctataaaatgtgcaatagccttatgtctacaattacatactttaaaaactactttattgctaaaaatgcaaatgatcatctgagccttcagtgaattttaatttttgctgataaagagtctttcctctgtgttgatggctgctgaatgattaaggtggtggttgctgcatgattaaggtggtggttgctgcagattgaggtggttgtggcaatttcttaaaataaaacaagagtaaagtttgctgcatcagttgactccttgattcctttgatgaaaggtttatctgtagtgtgccatgctgttggatagcattttacttcacagtagaacacctttcaaaatgagtc

SEQ ID NO: 464215 - DNA, 297 bp, Homo sapiens
ccaatttaattgttgaattacagattttgcattttgtgtcatatgtaaaaatgtttgcctagcacaaggtcacaaagattgttcctgtgtttgttctagaaattttatagatttggatcttccatttaaatctgtgctccattttgagtttccttttgtctatggagtgaggtgaggtatggattcaagttcactttttggatatggacagccaattgttccaacaccgcatgttgaaaaggctatcctttctccactgcattgccatcctgccgtcgacgcgggccgcgaaattta

SEQ ID NO: 464216 - DNA, 3958 bp, Homo sapiens
accatcgactcggcccctccgacggcttagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgagatttgccatacagcaagaaaaaaagaaaagaagaaatgttgaagagttgcaccaaaaagttagggaaaagttaagaatcacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatgaggaaacattagcagaaacgatagcctgttatagtggacagcttgctgctctgacggatgaaaacacaacgctccgttctaaactggagaagcaaagagagagcgggcaaagactggaaacagaaatgcaatcataccgttgtagactgaatgctgctctatgtgatcatgatcaaagtcactcatcaaaaagagaccaagagcttgctttccagggcacagtagataaatgttgtcatttacaggaaaatttgaattctcatgttctgattctttctctgcaactttctaaagctgagagtaagttcagagtcctcgaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaagcaggaaagattttgtcaactaaaaaaacaaaatatgttgcttcaacagcaactggatgatgctcgcaacaaagctgacaatcaagaaaaagcaatacttaatattcaagccagatgtgatgctagagtagaaaaccttcaagctgagtgcagaaagcaccgtctcttactagaagaagacaataaaatgttggtgaatgaattgaatcattcgaaagaaaaaaaatgccaatatgaaaaagagaaagcagaaagagaagtagctgtgagacagcttcaacaaaaacaagatgatgtcttaaacaaacgatcagcaacaaaagctttgctggatgcttcatcgcgtcactgcatctatttagaaaatgggatgcaggattcaaggaagaaattagaccagatgagaagtcaagtatgtatgcaactttgcacaccaacaactgttaatctgtagctagttaactaatataaagtgttttggggtactaattttagtggatggctttcttttgtatttttatgataattaatgttattaaaattttatagtggatggctttcttctgtattttccttattattaattttattaagattttattataatgcacctatatcttaatctctggctttcattctgccattttttatacatatatttttttcttaaatatttaaccttaggaaagttgagaattatgcatcatttctcacagaaattgagagagtttttttcctgttaaacgtctatttttaatgatttctctattggcatggtgaggcaagccagattaattcagaggataatgtctaatggaatgtttcagaaaattatcttctttttagtctctacttttctgaatgtataaagaacctgtgtatacttatttcatagatttcaggttaatttgttcagaaaggccattttactgaataaatttttatttcgatgaaaatcgttactccttttgtattgggctcagagagcacactctgtctctatatgaatatggacagttcgcatttgccaacatgtatctattttctcttatttgtagaaaaagctaaactaaaaagggggttatagaaggtcagcaaaggatgggtttgagatgtttgggttggttaagtgggcatttagacaacagggcttctcctttggcatgtttaatggacacctttgcagtttaagatgatgcttttaaattacttctctcctaatgatgacctgagtcctgctattcaatgggagagtcaataatatcctgtaggatcttatttggaactgactttgtcgattttaattttgttcctgcttgtttttaaattttcttgttgtttccctagaaagaaaagatgacgcttagttttaaatatttaaaaatgtgcaagttgctttgctataataaaactaaatgcatacatacaaaaaataaaattatagttgatgtggtagtgtttggaattcaaaatataaatgcttagcctgatgtaatcctttatctttccacattttaccagtttgtagaaaaatgacacagtagcccaatcgtctacttttgtgattgctaagaatttgtgtaattataccttcagaagtttgtttagaatttacatgatttaaaaacaattatgtgtgagagtaattattttaaaatgcacattttaggcttgaagtagaaaatgtcatgatgagaaaaattattaaaaaacaggatgaacaaattgagcggtttgagaaaatcctgcagcattcaagtttgattttggaatatttgcatatacctaatgaaatatcttgcggatggtacctgagtctaaacatgaaattcatttatgtttcatatataccttatgcacatagcctgaaggtaattctctacaatgttttacagtaattttttgcagaaactgatattatatgaaagttgggttgtttgattgagtcccataattgccatatgcatttgttattcttttttgttgttgtttttcccctgatggaatcatttcaaatgttttttctgtaagctcactgattctttttttctgctaataaaatcagctgctgaagcattgtattaaatttttagtttgttgtattctctatatctagaatttctatttgttttttgttatcatatctatttctacttcagaactatcattctgttaatgaattttttcccaaatttattttagtatgttatccatattttcttgtacaggcatacttcagggatattgcaggtgtggttccaggcaaccacaatgtaacaagaacttgaatttttggttttacactgcatataaaagttttttatactataccatagtctataaaatgtgcaatagccttatgtctacaattacatactttaaaaactactttattgctaaaaatgcaaatgatcatctgagccttcagtgaattttaatttttgctgataaagagtctttcctctgtgttgatggctgctgaatgattaaggtggtggttgctgcatgattaaggtggtggttgctgcagattgaggtggttgtggcaatttcttaaaataaaacaagagtaaagtttgctgcatcagttgactccttgattcctttgatgaaaggtttatctgtagtgtgccatgctgttggatagcattttacttcacagtagaacacctttcaaaatgagtc

SEQ ID NO: 464217 - DNA, 3915 bp, Homo sapiens
ccaatttaattgttgaattacagattttgcattttgtgtcatatgtaaaaatgtttgcctagcacaaggtcacaaagattgttcctgtgtttgttctagaaattttatagatttggatcttccatttaaatctgtgctccattttgagtttccttttgtctatggagtgaggtgagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgagatttgccatacagcaagaaaaaaagaaaagaagaaatgttgaagagttgcaccaaaaagttagggaaaagttaagaatcacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatgaggaaacattagcagaaacgatagcctgttatagtggacagcttgctgctctgacggatgaaaacacaacgctccgttctaaactggagaagcaaagagagagcgggcaaagactggaaacagaaatgcaatcataccgttgtagactgaatgctgctctatgtgatcatgatcaaagtcactcatcaaaaagagaccaagagcttgctttccagggcacagtagataaatgttgtcatttacaggaaaatttgaattctcatgttctgattctttctctgcaactttctaaagctgagagtaagttcagagtcctcgaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaagcaggaaagattttgtcaactaaaaaaacaaaatatgttgcttcaacagcaactggatgatgctcgcaacaaagctgacaatcaagaaaaagcaatacttaatattcaagccagatgtgatgctagagtagaaaaccttcaagctgagtgcagaaagcaccgtctcttactagaagaagacaataaaatgttggtgaatgaattgaatcattcgaaagaaaaaaaatgccaatatgaaaaagagaaagcagaaagagaagtagctgtgagacagcttcaacaaaaacaagatgatgtcttaaacaaacgatcagcaacaaaagctttgctggatgcttcatcgcgtcactgcatctatttagaaaatgggatgcaggattcaaggaagaaattagaccagatgagaagtcaagtatgtatgcaactttgcacaccaacaactgttaatctgtagctagttaactaatataaagtgttttggggtactaattttagtggatggctttcttttgtatttttatgataattaatgttattaaaattttatagtggatggctttcttctgtattttccttattattaattttattaagattttattataatgcacctatatcttaatctctggctttcattctgccattttttatacatatatttttttcttaaatatttaaccttaggaaagttgagaattatgcatcatttctcacagaaattgagagagtttttttcctgttaaacgtctatttttaatgatttctctattggcatggtgaggcaagccagattaattcagaggataatgtctaatggaatgtttcagaaaattatcttctttttagtctctacttttctgaatgtataaagaacctgtgtatacttatttcatagatttcaggttaatttgttcagaaaggccattttactgaataaatttttatttcgatgaaaatcgttactccttttgtattgggctcagagagcacactctgtctctatatgaatatggacagttcgcatttgccaacatgtatctattttctcttatttgtagaaaaagctaaactaaaaagggggttatagaaggtcagcaaaggatgggtttgagatgtttgggttggttaagtgggcatttagacaacagggcttctcctttggcatgtttaatggacacctttgcagtttaagatgatgcttttaaattacttctctcctaatgatgacctgagtcctgctattcaatgggagagtcaataatatcctgtaggatcttatttggaactgactttgtcgattttaattttgttcctgcttgtttttaaattttcttgttgtttccctagaaagaaaagatgacgcttagttttaaatatttaaaaatgtgcaagttgctttgctataataaaactaaatgcatacatacaaaaaataaaattatagttgatgtggtagtgtttggaattcaaaatataaatgcttagcctgatgtaatcctttatctttccacattttaccagtttgtagaaaaatgacacagtagcccaatcgtctacttttgtgattgctaagaatttgtgtaattataccttcagaagtttgtttagaatttacatgatttaaaaacaattatgtgtgagagtaattattttaaaatgcacattttaggcttgaagtagaaaatgtcatgatgagaaaaattattaaaaaacaggatgaacaaattgagcggtttgagaaaatcctgcagcattcaagtttgattttggaatatttgcatatacctaatgaaatatcttgcggatggtacctgagtctaaacatgaaattcatttatgtttcatatataccttatgcacatagcctgaaggtaattctctacaatgttttacagtaattttttgcagaaactgatattatatgaaagttgggttgtttgattgagtcccataattgccatatgcatttgttattcttttttgttgttgtttttcccctgatggaatcatttcaaatgttttttctgtaagctcactgattctttttttctgctaataaaatcagctgctgaagcattgtattaaatttttagtttgttgtattctctatatctagaatttctatttgttttttgttatcatatctatttctacttcagaactatcattctgttaatgaattttttcccaaatttattttagtatgttatccatattttcttgtacaggcatacttcagggatattgcaggtgtggttccaggcaaccacaatgtaacaagaacttgaatttttggttttacactgcatataaaagttttttatactataccatagtctataaaatgtgcaatagccttatgtctacaattacatactttaaaaactactttattgctaaaaatgcaaatgatcatctgagccttcagtgaattttaatttttgctgataaagagtctttcctctgtgttgatggctgctgaatgattaaggtggtggttgctgcatgattaaggtggtggttgctgcagattgaggtggttgtggcaatttcttaaaataaaacaagagtaaagtttgctgcatcagttgactccttgattcctttgatgaaaggtttatctgtagtgtgccatgctgttggatagcattttacttcacagtagaacacctttcaaaatgagtc

SEQ ID NO: 464218 - DNA, 474 bp, Homo sapiens
aaatatccggcctatccccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgaggtatgacctagttttaaa

SEQ ID NO: 464219 - DNA, 3981 bp, Homo sapiens
aaatatccggcctatccccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgagatttgccatacagcaagaaaaaaagaaaagaagaaatgttgaagagttgcaccaaaaagttagggaaaagttaagaatcacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatgaggaaacattagcagaaacgatagcctgttatagtggacagcttgctgctctgacggatgaaaacacaacgctccgttctaaactggagaagcaaagagagagcgggcaaagactggaaacagaaatgcaatcataccgttgtagactgaatgctgctctatgtgatcatgatcaaagtcactcatcaaaaagagaccaagagcttgctttccagggcacagtagataaatgttgtcatttacaggaaaatttgaattctcatgttctgattctttctctgcaactttctaaagctgagagtaagttcagagtcctcgaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaagcaggaaagattttgtcaactaaaaaaacaaaatatgttgcttcaacagcaactggatgatgctcgcaacaaagctgacaatcaagaaaaagcaatacttaatattcaagccagatgtgatgctagagtagaaaaccttcaagctgagtgcagaaagcaccgtctcttactagaagaagacaataaaatgttggtgaatgaattgaatcattcgaaagaaaaaaaatgccaatatgaaaaagagaaagcagaaagagaagtagctgtgagacagcttcaacaaaaacaagatgatgtcttaaacaaacgatcagcaacaaaagctttgctggatgcttcatcgcgtcactgcatctatttagaaaatgggatgcaggattcaaggaagaaattagaccagatgagaagtcaagtatgtatgcaactttgcacaccaacaactgttaatctgtagctagttaactaatataaagtgttttggggtactaattttagtggatggctttcttttgtatttttatgataattaatgttattaaaattttatagtggatggctttcttctgtattttccttattattaattttattaagattttattataatgcacctatatcttaatctctggctttcattctgccattttttatacatatatttttttcttaaatatttaaccttaggaaagttgagaattatgcatcatttctcacagaaattgagagagtttttttcctgttaaacgtctatttttaatgatttctctattggcatggtgaggcaagccagattaattcagaggataatgtctaatggaatgtttcagaaaattatcttctttttagtctctacttttctgaatgtataaagaacctgtgtatacttatttcatagatttcaggttaatttgttcagaaaggccattttactgaataaatttttatttcgatgaaaatcgttactccttttgtattgggctcagagagcacactctgtctctatatgaatatggacagttcgcatttgccaacatgtatctattttctcttatttgtagaaaaagctaaactaaaaagggggttatagaaggtcagcaaaggatgggtttgagatgtttgggttggttaagtgggcatttagacaacagggcttctcctttggcatgtttaatggacacctttgcagtttaagatgatgcttttaaattacttctctcctaatgatgacctgagtcctgctattcaatgggagagtcaataatatcctgtaggatcttatttggaactgactttgtcgattttaattttgttcctgcttgtttttaaattttcttgttgtttccctagaaagaaaagatgacgcttagttttaaatatttaaaaatgtgcaagttgctttgctataataaaactaaatgcatacatacaaaaaataaaattatagttgatgtggtagtgtttggaattcaaaatataaatgcttagcctgatgtaatcctttatctttccacattttaccagtttgtagaaaaatgacacagtagcccaatcgtctacttttgtgattgctaagaatttgtgtaattataccttcagaagtttgtttagaatttacatgatttaaaaacaattatgtgtgagagtaattattttaaaatgcacattttaggcttgaagtagaaaatgtcatgatgagaaaaattattaaaaaacaggatgaacaaattgagcggtttgagaaaatcctgcagcattcaagtttgattttggaatatttgcatatacctaatgaaatatcttgcggatggtacctgagtctaaacatgaaattcatttatgtttcatatataccttatgcacatagcctgaaggtaattctctacaatgttttacagtaattttttgcagaaactgatattatatgaaagttgggttgtttgattgagtcccataattgccatatgcatttgttattcttttttgttgttgtttttcccctgatggaatcatttcaaatgttttttctgtaagctcactgattctttttttctgctaataaaatcagctgctgaagcattgtattaaatttttagtttgttgtattctctatatctagaatttctatttgttttttgttatcatatctatttctacttcagaactatcattctgttaatgaattttttcccaaatttattttagtatgttatccatattttcttgtacaggcatacttcagggatattgcaggtgtggttccaggcaaccacaatgtaacaagaacttgaatttttggttttacactgcatataaaagttttttatactataccatagtctataaaatgtgcaatagccttatgtctacaattacatactttaaaaactactttattgctaaaaatgcaaatgatcatctgagccttcagtgaattttaatttttgctgataaagagtctttcctctgtgttgatggctgctgaatgattaaggtggtggttgctgcatgattaaggtggtggttgctgcagattgaggtggttgtggcaatttcttaaaataaaacaagagtaaagtttgctgcatcagttgactccttgattcctttgatgaaaggtttatctgtagtgtgccatgctgttggatagcattttacttcacagtagaacacctttcaaaatgagtc

SEQ ID NO: 464220 - DNA, 962 bp, Homo sapiens
cccccccccccaaaacaatactaatacacccccaaccacccacatcacgggcatgggagtcctgaccttgttttcctgcaactaaacagtctcacgatgatgggagacagtgatacgtcatcaggcatgatcttctctcaagaagcctgcaacctggaatcttctcacaaggagtgtgcaacctagattcttctcacaaggagagtgcaagctaaattcttcgcatgtgcagttcacgataggtttcatgctcccatgagaatctaatgctgatgctaatctgactggaggcagagctcagggaaggatgagagtgaaggggagtggctgtctcacgccacttgattactaccctgatttctctatccatagctaccaaccctactttaatatgtgcaactttctgaaaataaaattttaaacaggggactgaaggaaacgagactatttcactcagaaatttggttaaagaaatagttgcaaggtctctctggcctctcccctaccctgctgttatctctgaatcacctgtctctctcgagcacaggattaatctgttctctcaagttcccttactttcctagaaaccagatatgctaaagagaaacagagttgccttctctgaaatttcattaaccagaaaagatgaaaactcatattccagaggaggagattgaaaactaaaccctacacctagagcccagactttgttccaaatcaaactctctgttcaatttaatttccaaagaaattatttattaaccattgtctgagcattaaatctattcattttccccataaaaagcatttactatccctcagacggccccatttctcctaactcttcttcccctatgaagaaggcgttatacacatctgtaccacattgagttactgggtaatcatttttctgtaatttccttatgctatgcacattaaaattaatttgtatgcattttcct

SEQ ID NO: 464221 - DNA, 924 bp, Homo sapiens
ttggaattttgtagtgttatgtagtagagtgaggaaggagcagtcctctagtctcacgatgatgggagacagtgatacgtcatcaggcatgatcttctctcaagaagcctgcaacctggaatcttctcacaaggagtgtgcaacctagattcttctcacaaggagagtgcaagctaaattcttcgcatgtgcagttcacgataggtttcatgctcccatgagaatctaatgctgatgctaatctgactggaggcagagctcagggaaggatgagagtgaaggggagtggctgtctcacgccacttgattactaccctgatttctctatccatagctaccaaccctactttaatatgtgcaactttctgaaaataaaattttaaacaggggactgaaggaaacgagactatttcactcagaaatttggttaaagaaatagttgcaaggtctctctggcctctcccctaccctgctgttatctctgaatcacctgtctctctcgagcacaggattaatctgttctctcaagttcccttactttcctagaaaccagatatgctaaagagaaacagagttgccttctctgaaatttcattaaccagaaaagatgaaaactcatattccagaggaggagattgaaaactaaaccctacacctagagcccagactttgttccaaatcaaactctctgttcaatttaatttccaaagaaattatttattaaccattgtctgagcattaaatctattcattttccccataaaaagcatttactatccctcagacggccccatttctcctaactcttcttcccctatgaagaaggcgttatacacatctgtaccacattgagttactgggtaatcatttttctgtaatttccttatgctatgcacattaaaattaatttgtatgcattttcct

SEQ ID NO: 464222 - DNA, 1253 bp, Homo sapiens
actcattaaatgtctaagtcacttccaaataagaaaaaaatgctaaaacaaaaatttctaaatgaaattgatcatcaatgcttgtgggttgtgggtaaagatcttgatcaaaaggaggaaatgtctgaaagctgtaagaatcaaaatggagtcacttgtgttaaaaccctgacaaatagagctggggaaggccatgaactggaagataaaacacgactgaaaaatagctattgcaggctgggtagtccaagatcaaagacatcagaaaatttggtgtctggcgagggtccacttcccaattcatgcacagtatcttttggctataacatcttatggttaaaaggtgggagtcctgaccttgttttcctgcaactaaacagtctcacgatgatgggagacagtgatacgtcatcaggcatgatcttctctcaagaagcctgcaacctggaatcttctcacaaggagtgtgcaacctagattcttctcacaaggagagtgcaagctaaattcttcgcatgtgcagttcacgataggtttcatgctcccatgagaatctaatgctgatgctaatctgactggaggcagagctcagggaaggatgagagtgaaggggagtggctgtctcacgccacttgattactaccctgatttctctatccatagctaccaaccctactttaatatgtgcaactttctgaaaataaaattttaaacaggggactgaaggaaacgagactatttcactcagaaatttggttaaagaaatagttgcaaggtctctctggcctctcccctaccctgctgttatctctgaatcacctgtctctctcgagcacaggattaatctgttctctcaagttcccttactttcctagaaaccagatatgctaaagagaaacagagttgccttctctgaaatttcattaaccagaaaagatgaaaactcatattccagaggaggagattgaaaactaaaccctacacctagagcccagactttgttccaaatcaaactctctgttcaatttaatttccaaagaaattatttattaaccattgtctgagcattaaatctattcattttccccataaaaagcatttactatccctcagacggccccatttctcctaactcttcttcccctatgaagaaggcgttatacacatctgtaccacattgagttactgggtaatcatttttctgtaatttccttatgctatgcacattaaaattaatttgtatgcattttcct

SEQ ID NO: 464223 - DNA, 1353 bp, Homo sapiens
gtcctcataacagccaacttcttgcaactttcaagctgacggcctcaggaatgggaggaaggactcctccactggagaactgatagcagtattctggtagaggaggcatcaagagtcctgggaggccggtggtaatcatgtaggcaccatggaaactgctatgtgcgtttgctgtccatgttgtacatggcagagatgttgtcctcagttatgctcctgtctgtgctgcaagttcatcttcacctcagagcggaactgcacctgcttcccctgcccttacaaagatgagcggaactgccagttctgccactgcacctgttctgagagccccaactgccattggtgttgctgctcttgggccaatgatcccaactgtaagtgctgctgcacagccagcagcaatctcaactgctactactatgagagccgctgctgccgcaataccatcatcactttccacaagggccgcctcaggagcatccatacctcctccaagactgccctgcgcactgggagcagcgatacccaggtggatgaagtaaagtcaataccagccaacagtcacctggtgaaccacctcaattgccccatgtgcagccggctgcgcctgcactcattcatgctgccctgcaaccacagcctgtgcgagaagtgcctgcggcagctgcagaagcacgccgaggtcaccgagaacttcttcatcctcatctgcccagtgtgcgaccgctcgcactgcatgccctacagcaacaagatgcagctgcccgagaactacctgcacgggcgtctcaccaagcgctacatgcaggagcacggctacctcaagtggcgctttgaccgctcctccgggcccatcctctgccaggtctgccgcaacaggcgcatcgcttacaagcgctgcatcacctgccgcctcaacctgtgcaacgactgcctcaaggccttccactcggatgtggccatgcaagaccacgtctttgtggacaccagcgccgaggaacaggacgagaagatctgcatccaccacccatccagccgcatcatcgagtactgccgcaatgacaacaaattgctctgcaccttctgcaagttctctttccacaatggccacgacaccattagcctcatcgacgcctgctccgagagggccgcctcactcttcagcgccatcgccaagttcaaagcaggtcctccccttttccactccttcagcctaacttctagttcaggaacacatggggaagatggcgtggggtaatctgttaagtgagtgccttaacagattccacctagtggagcaatcaaggcaccaggaaacactgtgctaccctgcaagtcactatcctggtgtcc

SEQ ID NO: 464224 - DNA, 1262 bp, Homo sapiens
tggctttctcaagttgcgcagcattcttcaggagaaagagaagatcatcatggagcagatagagaatctagaagtgtccaggcagaaggaaattgaaaaatatgtgtatgttacaaccatgaaagtgaacgagatggatggtctgatcgcctactccaaggaagccctgaaggagactggccaggtggcattcctgcagtcagccaagatcctggtggaccagatcgaggacggcatccagaccacctacaggcctgacccacagctccggctgcactcaataaactacgtgcccttggactttgttgagctttccagtgccatccatgagctcttccccacagggcccaagaaggtacgctcctcaggggactccctgccctccccctaccccgtgcactcagaaacaatgattgccaggaaggtcactttcagcacccacagcctcggcaaccagcacatataccagcgaagctcctccatgttgtccttcagcaacactgacaagaaggccaaggtgggtctggaggcctgtgggagagcccagtcagccacccccgccaaacccacagacggcctctacacctactggagtgctggagcagacagccagtctgtacagaacagcagcagcttccacaactggtactcattcaacgatggctctgtgaagaccccaggcccaattgttatctaccagactctggtgtacccaagagctgccaaggtttactggacatgtccagcagaagacgtggactcttttgagatggaattctatgaagtcattacttctcctcctaacaacgtacaaatggagctctgtggacaaattcgggacataatgcagcaaaatctggagctgcacaacctgacccccaacacagaatacgtgtttaaagttagagccatcaatgataatggtcctgggcaatggagtgatatctgcaaggtggtaacaccagatggacatgggaagaaccgagctaagtggggcctgctgaagaatatccagtctgccctccagaagcacttctgagccccttcagagcaggaaacaacctcagactcatcacaaagtagacatatacacacacatatatgtatgtatatttttctcaccacattcttcaaggaggttgtagacaaatgtttccatgacctctcagctttccaacaggaatcttgtaagagctaataaaaggaaatacctgacatggcttgctgtttgttcaatgacaactatttgttatgatgacagt

SEQ ID NO: 464225 - DNA, 1056 bp, Homo sapiens
  misc_feature (973)..(973): n is a, c, g, or t
  misc_feature (995)..(995): n is a, c, g, or t
  misc_feature (1008)..(1008): n is a, c, g, or t
  misc_feature (1017)..(1017): n is a, c, g, or t
gcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacnacttcttaagctaaatggtatnttcatttttctcnagctctccnataaatatgaccaccaagatgcaacaaaaaacaaaccac

SEQ ID NO: 464226 - DNA, 693 bp, Homo sapiens
gcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagcacaatctcggcgaccagctctggaggcgagcgattgagcacactgtggacggtgcggaggagggaggaccagccctcgttgtggaaggggatgatgatgcttgtgttgggaagtgtctccaggtagcgcttgctacttgcagtttgggtgcttaagcgatcaagcaag

SEQ ID NO: 464227 - DNA, 726 bp, Homo sapiens
gcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatggagcgtcgcgctgggtaccga

SEQ ID NO: 464228 - DNA, 594 bp, Homo sapiens
  misc_feature (62)..(62): n is a, c, g, or t
  misc_feature (511)..(511): n is a, c, g, or t
  misc_feature (533)..(533): n is a, c, g, or t
  misc_feature (546)..(546): n is a, c, g, or t
  misc_feature (555)..(555): n is a, c, g, or t
tagtgcactcttctatatccacgagggtaagggtctgaaacatggcggacgacgtagaccancaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacnacttcttaagctaaatggtatnttcatttttctcnagctctccnataaatatgaccaccaagatgcaacaaaaaacaaaccac

SEQ ID NO: 464229 - DNA, 283 bp, Homo sapiens
caacaaactaccaacactgtagaggagcccctggatcttatcaggctcagcctagatgagcgaatttatgtgaaaatgagaaatgaccgagagcttcgaggcagattacatgtaagtaaatttatcaagttaccttgaaatcagattccttcctacccccactcccttgaaatgtaaaacctgtccagagtgaaagggtattttgaaggaagagagggtggtggaaagtcacccatatcacataagccaaataaagcggcatgtattcacatttttaacattt

SEQ ID NO: 464230 - DNA, 3445 bp, Homo sapiens
gcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagctgcacagtattccatggtgtatatgtgccacattgtcttaatccagtctatcattgatgcacatttgggttggttccaagtctttgctattgtgaatagtgccgcaataaacatacatatgtatgtgtctttatagtagcatgatttataatcctttgggtatatgcccagtaatgggattcctgggtcaaatagtatttccagttctagatccttgaggaatcaccacactgtcttccacaatggttgaaataattttcactcccaccaacagtgtaaaagcatttcagtttttccacaacctctccagcatctgttgtttcctggctttttaatgatcgccattctaactggcatgagatggtatctcattgtggctttgatttgcatttctctaatgacagtgatgatgagctttttttcatatgtcttttggctgcataaatgtcttcttttgagaagtgtctcttcatatcctttgcccattttttgatggggttgttttttttcttgtagatgtgtttaagtcctttgtagattctggatattagccttttgtcagatggatggattgtaaaaattttctcccattctgtaggttgcctgttcactcatgatagtttcttttgctgtgcagaagatctttagtttaattagatcccatttgtcaattttggcttttgttgccattgcttttggtgttttagacatgaagtctttgcccatgcctatgtcctgaatggtattgcccgggttttcttctaggatgtttatggtcctaggtcttacatttaagtctttgatccatcttgagttgatttttgtaaaaggtgtaaggaagggatccagtttcagttttctgcatatagctagccagttttcccaacaccatttattaaatagggaatcttttccccattgcttgtgtgcatcagatgtccgctatgtgccaggatctgtccacagaggcctgagcaagaccaactatgtgcacgatgctaagagctgggaaggacctgaaatgggtgaggagatgggaggtgacatggtgttgtgggggcttcaaggtagaagagaaatggatgaaaccagctccatgaacaaggtcaccccgccaatatcacgagaaaatgacatcactgtcagcttccgctcaggaaaaacctgggacttgaataaccaagggaaagggcaggcgcttaagaagacagtgctgagcaccagaggcacagccccaccaccacggagcctgctggtatcttaggcttcattcgtttttctttatttttttcctttctgctcctcatactgagtaatctcaattgacctttcttcaagattgctgattctttcttctacttgttcaaatatgctgttgaatctctctgaaaaaaaattattttaattattgtagttttcaactttagattttctccttggttccccttacaatttctatcacatcattggtaatctctatttttttgaaatataattctcattatttcctttagttttttgtacatagtttcctttagctctttgggtatattttaaatagttggtttatattctgtttagtaagttcaatgtcttgtcttcctcaagaactgtttctattatttctttatttcctgtgtatgggctacactttctcgtttcattgcatgactcataattttttgttgaaagctgaacattttgaatattatgatatggcacatctggaaatcatcttcctcccaccagggtttattgcagctgctttttgtgattgttgttgtttgattgcttagttctctttccttaattaattttgaaaagactttatttgttgttgtatatagccactgaagtctttgttttgttagcctagtggtcagctggtgatttaaatacagacatgtattctttgcctggaacaaaaaaagaaaataaaatctctcggtgtcagcaaatggactctatgtgcatgctggagtataccttcaacacctggagaagcactttaccactctgccttagtcttcacttcctccttgtggagagccttgaggttcgcccccttggttcagtccccctaggtccatgcaggctacaagtggcacttgaacaggcaacagtccgaacacagggactatgaggacatgaacgaagaaggtctgccggagcagaggaactgaaattgaaaggtgaacagggatgccgggccgggtctgccagcagcggatataagtctgtaaaatcagatggactgccaattggagaatgagagctgcccagcctggccttatgttctttcaattaattcataaacagaaagggggatatgcagggagccgaaggcccgtaggattcggcattccactggaggctatgtgatcaaacagcaaactgtttatcatgaatgcagaatgtgggcaaactcacaactgctcctgccgacagaaggtttgctggaggcaatcactccctggcactgaggttatctactgcgacatctagagcctgttgttcgaggaatgcagtcttgcaagcctactctggactgagcagctgaccccttcttccaccccccttctcactatctcttttgcctaataaatatggagggctgtgtaaagctcagggcccttgtctactagaagcaaagtgccccctgactccttcttccaaatacactcttttgtctcttgtcttttattcccgcattcactccctttgttcggtccccctaggtctgtgtgggttacacagtggcaccccgaatagtgacagaatcaggtgttccacattttatgaacacccttcccatcatttgtcatttggtgaattattactcatccttcagattttagctttcaagccatttccttggagagacttcccccaagccccctcatattgaccatttccctct

SEQ ID NO: 464231 - DNA, 264 bp, Homo sapiens
  misc_feature (62)..(62): n is a, c, g, or t
tagtgcactcttctatatccacgagggtaagggtctgaaacatggcggacgacgtagaccancaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatggagcgtcgcgctgggtaccga

SEQ ID NO: 464232 - DNA, 563 bp, Homo sapiens
  misc_feature (480)..(480): n is a, c, g, or t
  misc_feature (502)..(502): n is a, c, g, or t
  misc_feature (515)..(515): n is a, c, g, or t
  misc_feature (524)..(524): n is a, c, g, or t
gtttcgataacttcaccataagacatactcgcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacnacttcttaagctaaatggtatnttcatttttctcnagctctccnataaatatgaccaccaagatgcaacaaaaaacaaaccac

SEQ ID NO: 464233 - DNA, 481 bp, Homo sapiens
gggactaatggtaaataatgtagacggtttctagttttgtcagtttatttgggcaaaaggattcaaaatgacatttatatttatatgttataaaaagtatttttggacttcatatatcagaaaaatataacaaatttgaaactttggatgtcagaaaagtataataaatctgtagcccacttacagaaacttatataaaaaataatgatttattcttttgttaaaaattatttagtactggctgggcatgatagctcatgcctgtaatcccagagctttaggaggctgaggcattaggatcacttgaagccaggaattcaagaccagcctgggcaacatagtgagaccctgtctctacaaaaaaaattaataaattagccagacatggtggtacacacctgtagacccagctacttgagaggctaaggtgggaggatcacttgagcctaggagttcaaggttacacacacgcacacataca

SEQ ID NO: 464234 - DNA, 451 bp, Homo sapiens
gggactaatggtaaataatgtagacggtttctagttttgtcagtttatttgggcaaaaggattcaaaatgacatttatatttatatgttataaaaagtatttttggacttcatatatcagaaaaatataacaaatttgaaactttggatgtcagaaaagtataataaatctgtagcccacttacagaaacttatataaaaaataatgatttattcttttgttaaaaattatttagtactggctgggcatgatagctcatgcctgtaatcccagagctttaggaggctgaggcattaggatcattgaactcagcaagtggaggttgctatgagctgagattgtgccagttcattccaccctgggcaacagggtgagactctgtctcaaaaaaaaaaaaaaaaaaaaaaagaattccatgattcttttgagctctcaagagctactttagcct

SEQ ID NO: 464235 - DNA, 2399 bp, Homo sapiens
tggagagagcagcaacatttgaacatgacagagataaagttaaaaggcaattcaagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagtgtttccagtgtcaagatactctttcattatatagacttgttctgcactctatccgggagtccatggcaaatgatgtggataaagagctaatgaagcaggaagatattgaatattgtctcctctcttttgatagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggagtgagtaccatggggttaataatgaaaataattaaccattttctctttgatgcaatgctgttttacatttttgtcaagtctaaagctaga

SEQ ID NO: 464236 - DNA, 3667 bp, Homo sapiens
tggagagagcagcaacatttgaacatgacagagataaagttaaaaggcaattcaagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagtgtttccagtgtcaagatactctttcattatatagacttgttctgcactctatccgggagtccatggcaaatgatgtggataaagagctaatgaagcaggaagatattgaatattgtctcctctcttttgatagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtctttgttcaacaagagctggcagagtagttaagacaaggagttcaaaaattccatgaatcttggccaggcatggtggctcatgcctgtaatcccaccactttgggagggtgatgcaggaggatcacttgaggccaggagttggagaccagcctggccaacatggtgaaaccctgtctctactaaaaatacaaaaaaaaattagctggacctggtggcgcatgcctgtaatcctagctactcaggaggctgaggcatgagaatcgcttgaactcagcaagtggaggttgctatgagctgagattgtgccagttcattccaccctgggcaacagggtgagactctgtctcaaaaaaaaaaaaaaaaaaaaaaagaattccatgattcttttgagctctcaagagctactttagcct

SEQ ID NO: 464237 - DNA, 2284 bp, Homo sapiens
gccccacgatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 464238 - DNA, 1938 bp, Homo sapiens
gccccacgatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 464239 - DNA, 1918 bp, Homo sapiens
gccccacgatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 464240 - DNA, 2178 bp, Homo sapiens
gccccacgatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 464241 - DNA, 2244 bp, Homo sapiens
  misc_feature (1786)..(1786): n is a, c, g, or t
  misc_feature (1789)..(1789): n is a, c, g, or t
  misc_feature (1797)..(1797): n is a, c, g, or t
  misc_feature (1823)..(1823): n is a, c, g, or t
ctatgcacacacacctgtgtttccacccacccaagttggattggaaactacggacccacccagtgaggaagaaggtgacctggtctggggtggggaagagagtctgagagggggtggtggctggcagtctcggtggctggcgacgcctcttccgctcttccttcctgggaggaggcgggcaaggcgaagactctccgctcagtcgatggtttccttcaggacgtctcatagaggtgtgggtgagatcccaggtctgggccgcaatttctagccacgctgcccaaccttcaggcaagcagtcaggttccacagctaccccaccacactctcagagtcgaggggaacaagaagagggagtggtctgtaaatgcgtcgggacaagagtgccctcctaactccacctggagctggcgtcagggcgatctctggatgcccagcccataagcctggactgtctgtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcttccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagaagaagatgatgatgatgaataagttggttgtagcgcagttttttttcttgtctataaagcatttaacccccctgtacacaattcactctttttaaagaaaaaaattgaaatgtaaggcggtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaagttgcagctgttttgttgacattctgaatgcttctaagtaaatacaatttttttattagtattgttgtccttttcataggtctgaaatttttcttcttgaggggaagctagtcttttgcttttgcccattttgaatcacatgaattatacagngtntatccttncatatagttagctaataaaaagcttngtctacacaccctgcatatcataatgggggtaaagttaagttgagatagttttcatccataagtggaactttccaaaatcttgatcagttaagaaaatttcacataggcccacttactttaccaacctggggagtaagtcagtctatcaagcagtggctttagaaatcacacttggaaaagctgggcctgaggggctacatgaacagcttgtctacccttacttgaggagccactagctttaatccctacacggtagggggaattggggcgccatttagagacggtaggtttccccagggggttagaaaagcgcataaattgggagctctcgaaaaatggttattttttctgttattttcgggcaaactctaatatatgggccaaaaaaatggttatcactagaaacatatatatacttat

SEQ ID NO: 464242 - DNA, 2196 bp, Homo sapiens
  misc_feature (1738)..(1738): n is a, c, g, or t
  misc_feature (1741)..(1741): n is a, c, g, or t
  misc_feature (1749)..(1749): n is a, c, g, or t
  misc_feature (1775)..(1775): n is a, c, g, or t
ctatgcacacacacctgtgtttccacccacccaagttggattggaaactacggacccacccagtgaggaagaaggtgacctggtctggggtggggaagagagtctgagagggggtggtggctggcagtctcggtggctggcgacgcctcttccgctcttccttcctgggaggaggcgggcaaggcgaagactctccgctcagtcgatggtttccttcaggacgtctcatagaggtgtgggtgagatcccaggtctgggccgcaatttctagccacgctgcccaaccttcaggcaagcagtcaggttccacagctaccccaccacactctcagagtcgaggggaacaagaagagggagtggtctgtaaatgcgtcgggacaagagtgccctcctaactccacctggagctggcgtcagggcgatctctggatgcccagcccataagcctggactgtctgtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcttccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagaagaagatgatgatgatgaataagttggttgtagcgcagttttttttcttgtctataaagcatttaacccccctgtacacaattcactctttttaaagaaaaaaattgaaatgtaaggcggtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaagttgcagctgttttgttgacattctgaatgcttctaagtaaatacaatttttttattagtattgttgtccttttcataggtctgaaatttttcttcttgaggggaagctagtcttttgcttttgcccattttgaatcacatgaattatacagngtntatccttncatatagttagctaataaaaagcttngtctacacaccctgcatatcataatgggggtaaagttaagttgagatagttttcatccataagtggaactttccaaaatcttgatcagttaagaaaatttcacataggcccacttactttaccaacctggggagtaagtcagtctatcaagcagtggctttagaaatcacacttggaaaagctgggcctgaggggctacatgaacagcttgtctacccttacttgaggagccactagctttaatccctacacggtagggggaattggggcgccatttagagacggtaggtttccccagggggttagaaaagcgcataaattgggagctctcgaaaaatggttattttttctgttattttcgggcaaactctaatatatgggccaaaaaaatggttatcactagaaacatatatatacttat

SEQ ID NO: 464243 - DNA, 1806 bp, Homo sapiens
  misc_feature (1348)..(1348): n is a, c, g, or t
  misc_feature (1351)..(1351): n is a, c, g, or t
  misc_feature (1359)..(1359): n is a, c, g, or t
  misc_feature (1385)..(1385): n is a, c, g, or t
gaatgacagagcggagagagcgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcttccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagaagaagatgatgatgatgaataagttggttgtagcgcagttttttttcttgtctataaagcatttaacccccctgtacacaattcactctttttaaagaaaaaaattgaaatgtaaggcggtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaagttgcagctgttttgttgacattctgaatgcttctaagtaaatacaatttttttattagtattgttgtccttttcataggtctgaaatttttcttcttgaggggaagctagtcttttgcttttgcccattttgaatcacatgaattatacagngtntatccttncatatagttagctaataaaaagcttngtctacacaccctgcatatcataatgggggtaaagttaagttgagatagttttcatccataagtggaactttccaaaatcttgatcagttaagaaaatttcacataggcccacttactttaccaacctggggagtaagtcagtctatcaagcagtggctttagaaatcacacttggaaaagctgggcctgaggggctacatgaacagcttgtctacccttacttgaggagccactagctttaatccctacacggtagggggaattggggcgccatttagagacggtaggtttccccagggggttagaaaagcgcataaattgggagctctcgaaaaatggttattttttctgttattttcgggcaaactctaatatatgggccaaaaaaatggttatcactagaaacatatatatacttat

SEQ ID NO: 464244 - DNA, 1685 bp, Homo sapiens
  misc_feature (1227)..(1227): n is a, c, g, or t
  misc_feature (1230)..(1230): n is a, c, g, or t
  misc_feature (1238)..(1238): n is a, c, g, or t
  misc_feature (1264)..(1264): n is a, c, g, or t
gaatgacagagcggagagagcgaggaggctgcgtctggctcccgctctcacagccattgcagtacattgagctccatagagacagcgccggggcaagtgagagccggacgggcactgggcgactctgtgcctcgctgaggaaaaataacagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcttccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagaagaagatgatgatgatgaataagttggttgtagcgcagttttttttcttgtctataaagcatttaacccccctgtacacaattcactctttttaaagaaaaaaattgaaatgtaaggcggtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaagttgcagctgttttgttgacattctgaatgcttctaagtaaatacaatttttttattagtattgttgtccttttcataggtctgaaatttttcttcttgaggggaagctagtcttttgcttttgcccattttgaatcacatgaattatacagngtntatccttncatatagttagctaataaaaagcttngtctacacaccctgcatatcataatgggggtaaagttaagttgagatagttttcatccataagtggaactttccaaaatcttgatcagttaagaaaatttcacataggcccacttactttaccaacctggggagtaagtcagtctatcaagcagtggctttagaaatcacacttggaaaagctgggcctgaggggctacatgaacagcttgtctacccttacttgaggagccactagctttaatccctacacggtagggggaattggggcgccatttagagacggtaggtttccccagggggttagaaaagcgcataaattgggagctctcgaaaaatggttattttttctgttattttcgggcaaactctaatatatgggccaaaaaaatggttatcactagaaacatatatatacttat

SEQ ID NO: 464245 - DNA, 8075 bp, Homo sapiens
ggaaggcatatatcgtcaaggatgttcagcagtacattcttcatcgtttagatcaagaagaagctttgcgacaacacctcacaaaagaaactgcagagatgttaaatcaactgcacattaaaagcagtggatgctttctttacctagaacgagttttagatggagttgtagaaaattttattatgttaagagaaattcgtgacatcccaggaactctaaatggtttatatctctggctgtgccaaagactttttgtaagaaaacaatttgcaaaggttcagcctattttgaatgtgattcttgcagcctgccgacctttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggattccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattgcgttgcctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaacttgcgtcacttcttcatgacctctttccccaccagaacacagcatacacatgctgtatgtatacatacacacaaatggctttttgaatttgtgggttccacatccctggatgcaaccaatctcagataaaatattcggaaagaaaattctaaagttctgaaaaacaaatttgctatgtgccaagtactacctgagtccacctgaatgaagtgatgtgtaggcattgtattaggtattgtaagtaatctagagatgatttaaagtatacagagcatatgcgtaggttatatataaatgttgtgccatttcatataagggacaggagtgtctgaggattttggtatccaagaggagtcctggaaacaatctccctatgtttactaatgaataactatcctattactccaaagagaggtttctaaaaaggccaacaaggtatcttctgttctgtaatttcatgaaaattgtagtgttctgcagttatattttttataaatttgttgaattaatataaatcttattctaaaaaattaataatataacaatgtgtttaaacacaaatgtatggtatacatagaagaatttaaaaacagaccggtagctaaataaacttacatggagttttctagctaatggtccaaggaaatacactgtgagaacttggtgataattaatgttttcactcctttgccctagcagttggaaggattacaactacagtcgtcccactgtatcctgggtggattggttccaggaacccaggtgggtactaaaatctttgtatgctcaagtcccacagttggcctcctgtatttacagattctgcatctctccaatattgtattttccatctgtgattgggagaatctgtagatgcagaatccacagataggaagggctgaatgtagcagtgatgagatacaccctgaggattatgttgtagaatttctgtgaaaaattcatttattgtgcaaatatttgtgctaatcttattttcaagatatagcctctgcttaccagtcttgctgttatagtaaaattataattagccaattttaaaataaaattatttgaaatttaaaaaaa

SEQ ID NO: 464246 - DNA, 2674 bp, Homo sapiens
agaaagtgcagagtgagaagagaagagagtcctatagagagaggactccaagagtgatgctgaaggacgtggatgaagctggaagccatcattctcagcaaagttacactggaacagaaaaccaaacaccacatgttctcactcgcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttattattttggctgctcttggggactgcgagaagcagagagaatgagagaccagtggcaactgcctgcacagcagagataaccctcttcccttgcttcctttaatagttaaatagactttgtataccacctggaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagggaagagaaggattatagaaaaggagaaaagggaggagcaagaacatctctccatggcctatttttatttttgttcccaagagactagtgtaataaccttatgcccccaaagacagcccagaactgagtatcttcagtggttcctgagtgtaaatcagtgaatctgttatatagaaagttaacatttcaggagcacaattatttcctgatttcaaatatgaacagaagactaaatgtcatttttttaaatcataaatttggtatccatagttactttacacattccagagtctaagcatggaatttaagttttgtattttgaacaaaaatagcaacatctgttttctgtatggcaaagaaaaactaaatcccagacttttatttttaaccacagaaaccatcacttctttctaaattatttgcttgcctgctcatttcccctaaacatctctgtttatgccaatggctttttaaatccaaataatactagttattgccaaattgcattagaatcctattgaattagaataattcatatacttcatatactaggcagtaaatggttagagacggtaaagatctgattgtgatcaaaagtagggtttttgttttgtttttaatcatgagcacatataaaaggaaattcaaatgaaaccaagccaatttctgatttagtaagattaaaaccatagatggagctcagttattaaggatggaaaggaggaaagcacagagtgaggagagaaaaaggggaaggaaaaaaagtagtgtttttttggggaacagtataatgtctcagaagttcttctctcttatcctgctgatgttgagacagtggctttgtataagcttttatttatacctatttcaacatcatgaaaatttttccatcagcattttcttgcaactttaaaaatcacaagggattatttgtttataaagagatacaggatctataatttattggcaatactttattttaggaatcttcaaattgtacttaataaataaatcacaggtcaaaatgactgtaaaatcaatcaggctttctcgtaagttatttcctgaaaa

SEQ ID NO: 464247 - DNA, 1224 bp, Homo sapiens
gctgacccctgtggctggactaatgtgtcatttcttaaaagcttttaatatgtttgcaggcttagccacaggagcaaagcaaattgttcttgagatcttcaaagcaggcgtgcaggtttcaccagttcttcctcttgccctgggcaggtctgcaagtctgctggaacctggaacacagcagccctcctgcccagccaccccattcctgagcttcctctccatgcaagagtccacttgtaaaacaaacaacgggctgggagttgtgtctccccttcaccaccagtttaaaaaaaatctcactcccgttcaggagcctggcaaccatgcattacccaacaatggttaccgtggctgcaaggaggaagcagacagcaagcccacagaagtgtttattgaagaaagggaagtcaatagtccctggagttaatgagtgattgttatttatggaaggaatggtatttgcagatgggaatgactgcaaaatgcatagaaggacacagccatgccctttccacggaagtcacagagcacacctcaacacactgagaagacgtccacgacagagaaagatgacgaaggtgcttctgtgtacagctcatccacttcctcatccgtaaactgatcccccacggttgtcagcagctctctcaggtaatcttcctgaatggtgcctgttgcttcttcatcaaagcaagcaaaagcatttctgatgacgtcttcaggatctgtgccatttaacttcttaccaaacatggcgagcaacatggtgaagttaatgggccctggtgcctcattcatcacggcatcaaggcatgcatcagtgggattcttccctagagaagcaagcataccatgcaaatcttccttgctgatgaaaccatctctgttctgatcaatcatgttgaaggcctctttgaactcctgaatctgtgactggtcaaacgtggcaaacaccttggacgttgcacactgagggcgcttcttggtggtcttgcctttttgctcaacatggtggttgcttaattccggcaccaaataccagaaacggaaccaccctgtgcgagatgacaagcgacagcgaggagcgcggggctgtggccagacagtggcggctatagagctatgatttaatactgcattttaaatttgcttacatgtacagtctgtatgttttcataaaatttaacttttaatagatttgtgtattttgtggtcgtgctcacc

SEQ ID NO: 464248 - DNA, 827 bp, Homo sapiens
gctgacccctgtggctggactaatgtgtcatttcttaaaagcttttaatatgtttgcaggcttagccacaggagcaaagcaaattgttcttgagatcttcaaagcaggcgtgcaggtttcaccagttcttcctcttgccctgggcaggtctgcaagtctgctggaacctggaacacagcagccctcctgcccagccaccccattcctgagcttcctctccatgcaagagtccacttgtaaaacaaacaacgggctgggagttgtgtctccccttcaccaccagtttaaaaaaaatctcactcccgttcaggagcctggcaaccatgcattacccaacaatggttaccgtggctgcaaggaggaagcagacagcaagcccacagaagtgtttattgaagaaagggaagtcaatagtccctggagttaatgagtgattgttatttatggaaggaatggtatttgcagatgggaatgactgcaaaatgcatagaaggacacagccatgccctttccacggaagtcacagagcacacctcaacacactgagaagacgtccacgacagagaaagatgacgaaggtctcctttcttccacatcgtaggagattttctgccataaactcagtttattctatagttgtttatgtcctcagcattttggagacagctgttctcatgaagtgaagactggctcagattgtttgattaattgcaagaattgtggaaacgggaggaagaattcatgaaggatgcctcccttacctgtacagagttgttttcattgataaagggttgtgatctgtaaaatggggatatcgacatttgttt

SEQ ID NO: 464249 - DNA, 1358 bp, Homo sapiens
ttttagagacagggtctcgctctgtctccaaagctggagtgcagctccatcatggttcactgcagcctccgcctcctgggtttgagcgatcctcccatttcagtgtaaccaccattcttatctctatcaccatagattagctctgcatgtctttgaacttcatataaatggaatcatgcatagataggctcttttgtgtctggattctctctgttaacactgtgtctgtgagactcactcacgctgtgtgtagtattatgcttcatccttttttgttgttgcatagtattccactgtataaatataccacaatttatttgtctgttttccaattgctgtgcatttggattgttttgtttttcactattttgaataaagctgctatgaacatccttgtatatgtcttgggtatacagatggtcctggcttacaatgattggatttaaaattgtttgactttatgatgggcttatcagggtattaaatgtgtttctgacttacagtatttttgacttaccacgtgtttattgggacgtaaccccttcctaagatgaagagcatctgtatacatccagaatcctgtggagcaactcataacccatgaggaatggaagccgacagacagactcatccccaggacagatggttctcactacatctcataaagcttcttagaagatcttacaggattgagcaaccagccagccacagcaggggccaactggataacacgtctttgcacaggctctccctctgtccctgtcaccctccccttttcctaaccttgttccttgggattatgttttgaaataaattattcagagaaatgaagccaaagctgacccattagccaatagctaggttctgtgatgacagagcttctgggctataatcgtttactgagaagccagcgttcctgaggggataatggctcgttccattcagctgcagcataggagtgagggcagggcattagcagaagataacaccagaaacgtgctctggggcctgttgatgactttctgtgccaagcgtagacatttagcctttattctgtatgtgatgggaagccagtgccagtggtgggtttgagcagggaaccagcaaccagtggtgggtttgagcagggaaccagcaatactcaagctctgcttggatggaggccagtcagggaggagttagggcaggaggaccagtcagggaggagacttagggcaggaggaccagtcagggaggagacttagggcaggaggactggtcagggaggagttagggctggaggacgggtcagggagtatgcatgggcctgtggaaccagagagaagctgggtcagagatagagctgtcggctagtcggg

SEQ ID NO: 464250 - DNA, 1336 bp, Homo sapiens
ccctgccgaggcccctcctgaatgagggccgagaactgcagggttggagcctgggaaccatggaaaccgtggccaggcattttccacaggacaccgggagcccctgaggcaacacctagcttttcagagagcggctgccggcacttctgcccagagcagaggcctgttcccttgactggccctgaggtgggaggaatgggagtccccgagggaggctacgacccctcccagcctccatgtcctcacctgagaaaacagggtcacaatacctgccttgccaacgtggtgaggaccagcggagaagatgaaagggcttatattccaaagcccacaaggttgaagatgcacacccgtgacacagcctcaggatgtcctgacgacatgtgccaaggtggtcatacgttttagggagacatgagacatcaatcaacacatgtaagatgaacattggttcagtctggaaaaggccgggcaacgccaagcaaacgtgggacaactcgcagccaggagaaagcttccaggtcacagatgaagagcatctgtatacatccagaatcctgtggagcaactcataacccatgaggaatggaagccgacagacagactcatccccaggacagatggttctcactacatctcataaagcttcttagaagatcttacaggattgagcaaccagccagccacagcaggggccaactggataacacgtctttgcacaggctctccctctgtccctgtcaccctccccttttcctaaccttgttccttgggattatgttttgaaataaattattcagagaaatgaagccaaagctgacccattagccaatagctaggttctgtgatgacagagcttctgggctataatcgtttactgagaagccagcgttcctgaggggataatggctcgttccattcagctgcagcataggagtgagggcagggcattagcagaagataacaccagaaacgtgctctggggcctgttgatgactttctgtgccaagcgtagacatttagcctttattctgtatgtgatgggaagccagtgccagtggtgggtttgagcagggaaccagcaaccagtggtgggtttgagcagggaaccagcaatactcaagctctgcttggatggaggccagtcagggaggagttagggcaggaggaccagtcagggaggagacttagggcaggaggaccagtcagggaggagacttagggcaggaggactggtcagggaggagttagggctggaggacgggtcagggagtatgcatgggcctgtggaaccagagagaagctgggtcagagatagagctgtcggctagtcggg

SEQ ID NO: 464251 - DNA, 814 bp, Homo sapiens
ccctgccgaggcccctcctgaatgagggccgagaactgcagggttggagcctgggaaccatggaaaccgtggccaggcattttccacaggacaccgggagcccctgaggcaacacctagcttttcagagagcggctgccggcacttctgcccagagcagaggcctgttcccttgactggccctgaggtgggaggaatgggagtccccgagggaggctacgacccctcccagcctccatgtcctcacctgagaaaacagggtcacaatacctgccttgccaacgtggtgaggaccagcggagaagatgaaagggcttatattccaaagcccacaaggttgaagatgcacacccgtgacacagcctcaggatgtcctgacgacatgtgccaaggtggtcatacgttttagggagacatgagacatcaatcaacacatgtaagatgaacattggttcagtctggaaaaggccgggcaacgccaagcaaacgtgggacaactcgcagccaggagaaagcttccaggtcacaggtgggtgagagacaaaggtcgcattcttttgagtttctgatgggcctttccaaagaaggcaatcagatatgcatctatctcagtgagcagggggtgattttgaatagaatggggggcaggtcggccctaagccattcccggcttgactttcccctttagcttagtgactttgggggcccaagatttattttcctttcacaaaacaataaacataacaaataagtgaattatagaaaggtgaaaactatggaaaaaaaagaaaaacagggagaaagaatcctgaaca

SEQ ID NO: 464252 - DNA, 1383 bp, Homo sapiens
ccctgccgaggcccctcctgaatgagggccgagaactgcagggttggagcctgggaaccatggaaaccgtggccaggcattttccacaggacaccgggagcccctgaggcaacacctagcttttcagagagcggctgccggcacttctgcccagagcagaggcctgttcccttgactggccctgaggtgggaggaatgggagtccccgagggaggctacgacccctcccagcctccatgtcctcacctgagaaaacagggtcacaatacctgccttgccaacgtggtgaggaccagcggagaagatgaaagggcttatattccaaagcccacaaggttgaagatgcacacccgtgacacagcctcaggatgtcctgacgacatgtgccaaggtggtcatacgttttagggagacatgagacatcaatcaacacatgtaagatgaacattggttcagtctggaaaaggccgggcaacgccaagcaaacgtgggacaactcgcagccaggagaaagcttccaggtcacagtatttttgacttaccacgtgtttattgggacgtaaccccttcctaagatgaagagcatctgtatacatccagaatcctgtggagcaactcataacccatgaggaatggaagccgacagacagactcatccccaggacagatggttctcactacatctcataaagcttcttagaagatcttacaggattgagcaaccagccagccacagcaggggccaactggataacacgtctttgcacaggctctccctctgtccctgtcaccctccccttttcctaaccttgttccttgggattatgttttgaaataaattattcagagaaatgaagccaaagctgacccattagccaatagctaggttctgtgatgacagagcttctgggctataatcgtttactgagaagccagcgttcctgaggggataatggctcgttccattcagctgcagcataggagtgagggcagggcattagcagaagataacaccagaaacgtgctctggggcctgttgatgactttctgtgccaagcgtagacatttagcctttattctgtatgtgatgggaagccagtgccagtggtgggtttgagcagggaaccagcaaccagtggtgggtttgagcagggaaccagcaatactcaagctctgcttggatggaggccagtcagggaggagttagggcaggaggaccagtcagggaggagacttagggcaggaggaccagtcagggaggagacttagggcaggaggactggtcagggaggagttagggctggaggacgggtcagggagtatgcatgggcctgtggaaccagagagaagctgggtcagagatagagctgtcggctagtcggg

SEQ ID NO: 464253 - DNA, 3656 bp, Homo sapiens
agcgtctagtagaattctgtcattcaaaaaagatttgtcggtcaacgacgacgatattaaacattgtatatgaagtctcaaaaaaacatggagcttactttgctctctcagaaagtcgatttctgcagccatttcgatacaattttacggtgcaatctgcatcctactcacgcggcatctacagccccgccacgcttctttcccccgcgccccagacgagtccctggccctggtgagagactgaagattgctggggactccacgttcaaccgaatcccacgctggtgggaagaggacgcggtcgatacaggcgtcccgcgggtcactctgggtctcgtcgggccacctaggagagtgccgcgggagcttgacggcagcctgagagcggcgttctacgcggagcggcgggggttggagaggacaacgccaagacggctgggaagccccaggccagcagcggaagtccactcggcccgccctgcgactttgaaaccggtgccccggaccactccttggagacggtggcgcctcttgcgtcatcacgcgggcgttggagcttacgccatcgcgcgtcctagagtcctagcacgctattggctggctgtcaagcaatgggaggagtcgtgagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccgtaagtataaaatgttttttcttacttattactacataatttgaacgtgttattttctagttataaatgatatagtaaaagctcattaattccagagtaagaatggtactctgaatttgcttgaatgatatgcttttatatatttcttagtttcaagtacagagcacatatttagaatgtatgtttagaatatactcatattctaaatgtttgaaaatcctatgtcaatattttcagttcattaatgtagatttttgtaataaatttcaagataatttttttcaaaacgaaaagtcattataaaacaaaaactctcattatttacgcaataaatttgcattattataatatagctgttcggaaataaaaggagagatatgggtataattaattgagctagcttataaaaatgtttcttttaggggatttttaaatgactagatgaaactttaattttatgtattacataattatgcattcatgtattcattctttattcatcatgcatttattaagtatatgctgtgtcacttttgcattcagtgccagggtttaaaaactaaaccacatatagattttcttagactcattacaaatattaaccttggactctctttgttcaggtttaactgtctcttgggaatcctgtttacctggttggcaaactatttcttttttcctgtagatgtacacctattatctaaattatagcacatttaaaattaataaagtatttaataatgaaatatttctttatattgcagttattcatttgaaatgccatttaaatgcctctcagtgtctaacattcagaagccattgctccttttgtaggctggacagagagctccaaacaattgatttaaatgagatttgtagatattcttttattttcttttattttgatattcagctaaatctaatgtagaaaagtctagctgtttgcgttctgttttttaagaagagtaatcatatacctttgtgtgttacatttcaactaacatgccaaaatttgttattgaaaaatatgattaattctcataaactgccatgagaagtaagaaaatttcaactattgtgtgcttatttttaccctacagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttgcttttggaggacagaagataatgagcataattaatctgatattgaaaaagaaagggtagcaagtggataaagcaattacaaatcacattccaaaattaatgcactgcacacaaccctctgcttttgtcaggggtagaaggggtatccagcctaaggcacctaagtccaagaggaatatgtgcctaacaaatcttctaactaaatatatatatatatatatatatatatataaaatatatatgtttatatataacatatatatatagagagagagcataaaatgtgctgtgtatgtgtgtagcatattttttgttaaatcaccattcctgggccctactcattttctgataatttcttatcttaatttgctctgaaagagcaaaacttataaaattgactattgtaactctattttttaccaactatcatttttcatggaaggaatagtaaaaagagttacctctgaagctaagatgacacatgtatgaggaatataggaagccagaaatcatgaatctatgaaaagtgaggggtgtctgtgcatattttattttatttcataataaataaccagtaattaaaatattcttttccatgtaatgggatctacgagtaaatttttgtctgatatttataaatctaatatgtaatataaaggagaaataggaaatgctgtcaaatgacatttcactttactacttatttgaattacaatgaaataatatatagctacatcactggctcctgagagagctttgggtgttctgtaaattttttactttgcactcttgaaaaattcgcagagaatgcaaggtttagtaaaaatttattttcttttggcagcctatcacctgtaatttccgttaaacagcatttctgactcaatagtacactgaaagcccatgtttgtaataatgccctaaagcactgcagtacctagagtatatattttgaagagatagctttgctgaaatagaaaaccaaactgtaaattgaagtctgagcattcagagaaataaaaattatgctaaaaacaaacgtatgtttttgaattagttttttgaaaaatggcaaaaagataatattagttagtgatattattaatatcattaatatcactaaatatcattagtatgctttggcatacacagcagaaacaccaaatgtcttata

SEQ ID NO: 464254 - DNA, 2837 bp, Homo sapiens
agcgtctagtagaattctgtcattcaaaaaagatttgtcggtcaacgacgacgatattaaacattgtatatgaagtctcaaaaaaacatggagcttactttgctctctcagaaagtcgatttctgcagccatttcgatacaattttacggtgcaatctgcatcctactcacgcggcatctacagccccgccacgcttctttcccccgcgccccagacgagtccctggccctggtgagagactgaagattgctggggactccacgttcaaccgaatcccacgctggtgggaagaggacgcggtcgatacaggcgtcccgcgggtcactctgggtctcgtcgggccacctaggagagtgccgcgggagcttgacggcagcctgagagcggcgttctacgcggagcggcgggggttggagaggacaacgccaagacggctgggaagccccaggccagcagcggaagtccactcggcccgccctgcgactttgaaaccggtgccccggaccactccttggagacggtggcgcctcttgcgtcatcacgcgggcgttggagcttacgccatcgcgcgtcctagagtcctagcacgctattggctggctgtcaagcaatgggaggagtcgtgagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatc

SEQ ID NO: 464255 - DNA, 2505 bp, Homo sapiens
agcgtctagtagaattctgtcattcaaaaaagatttgtcggtcaacgacgacgatattaaacattgtatatgaagtctcaaaaaaacatggagcttactttgctctctcagaaagtcgatttctgcagccatttcgatacaattttacggtgcaatctgcatcctactcacgcggcatctacagccccgccacgcttctttcccccgcgccccagacgagtccctggccctggtgagagactgaagattgctggggactccacgttcaaccgaatcccacgctggtgggaagaggacgcggtcgatacaggcgtcccgcgggtcactctgggtctcgtcgggccacctaggagagtgccgcgggagcttgacggcagcctgagagcggcgttctacgcggagcggcgggggttggagaggacaacgccaagacggctgggaagccccaggccagcagcggaagtccactcggcccgccctgcgactttgaaaccggtgccccggaccactccttggagacggtggcgcctcttgcgtcatcacgcgggcgttggagcttacgccatcgcgcgtcctagagtcctagcacgctattggctggctgtcaagcaatgggaggagtcgtgagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaataaaacgagaaaaaaaaaaaagaggggggcaaaaaaaccccggggccaatggaccctttttgaaagggcccaagggggataa

SEQ ID NO: 464256 - DNA, 1956 bp, Homo sapiens
gtatcaacgcagagtggctattacggccggggaggctgaaaagaagaagccagtgtttgagaaaagcttcgtgagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatc

SEQ ID NO: 464257 - DNA, 2179 bp, Homo sapiens
agggtacggtccggaattcccgggacgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgattttgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatc

SEQ ID NO: 464258 - DNA, 1914 bp, Homo sapiens
gcagctgggtggagcctaaagccgagccctctcctgtgacctcggctgaaaagaagaagccagtgtttgagaaaagcttcgtgagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtcccaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatc

SEQ ID NO: 464259 - DNA, 1966 bp, Homo sapiens
gcagctgggtggagcctaaagccgagccctctcctgtgacctcggctgaaaagaagaagccagtgtttgagaaaagcttcgtgagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatc

SEQ ID NO: 464260 - DNA, 2220 bp, Homo sapiens
agggtacggtccggaattcccgggacgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatc

SEQ ID NO: 464261 - DNA, 2188 bp, Homo sapiens
gcagctgggtggagcctaaagccgagccctctcctgtgacctcggctgaaaagaagaagccagtgtttgagaaaagcttcgtggtctgtgttctctagttgttccctcttctctctgacattcctttcgtcgtcgccagaatttttgtggatttggtggttgtatgaagaataagtgaatctaccagaacttcctagtagctaagatcttgattcccagaggatccagtaactgagacacctgcacactttacaataaataaaagacaaaggatgacataagaacccatggtgcttatagttacaagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatc

SEQ ID NO: 464262 - DNA, 760 bp, Homo sapiens
ctcactacagacaaaacacctgatgtctaatacaaatgaaatagtcactggaatccctcaaggcaatggagatgcatccacacatgggtgtgtgcacacacacacgcagagaaaatgtgttttatataacttacaaataaagagaatcccctattgggtccgatactcacatagaccaccaggcaaccttcagccattcaaacattatgtggtgattcatgttccaataaaaaatcatctacaggtgccccaagacatagattttccttctaacagtcagacccctattctacaggtctgctggagtttgctggaggtccactctagaccatgcttgcctgggtatcagcagcagtggctgcagaacagcaaagattgctgcctgctccttcctctggaagcttcatccgagggtggcacctgccagatgccagctggagctttcctgtatgaagtgtctgtcaacccctgctggtgccaggtgaccccactgctgatgacctggggcagagcttctagaatcacagctgtagaacctttgggaatcaaggattcttgcaaaattatcacaattgttgcgaattgtaacagacaaaagtagggagtttgaaaaaaaaacacaccagtaaggactggcatttgacaatggctgaaatattacttgaacaaattagaaagaagaaagacaggctgggcgcagtggctcacacctgtaatcccaacactttgggaggccaaggtgggtggatcacttgaaccc

SEQ ID NO: 464263 - DNA, 4357 bp, Homo sapiens
aagcgccagttcatgtcatcacactcactgagccctgggttgaaggcccagctttgcctacagcaggtcaaatatctaggactaatcttagccagagggatcagggccctcagcaaggagcaaacacagcctatactggcttatccttgccctaagacattaaaacagttgtgggggttccttggaatcaccggcttttgccgactatggatacccggatacagcgagatagccaggcccttctatactctaatcaaggagacccagagggcaaatactcatctagtacaatgggaaccaggggcagaaacagccttcaaaatcttaaagcaggccctagtacaagctccagctttaagccttcccacaggacaaaacttctctttatatgtcacagagagagcagggatagctcttggagtccttactcagacttgtgggacaacctcacaaccagtggcatacctaaggaccagtgcccagttagcagaactagtggcacttacccgagccttagaactgggaaagggaaaaagtataaatgtgtatacagatagcaagtatgcttatctaatcctatatgcccatgctgcaatatggaaagaaggggagttcctaacttttgggggaaactccattaaataccacaaggaaattatggaattattgcacacagtgcaaaaactcgaggaggtggcagtcttacactgccaaagccatcagaaaggtgaaagggaaaaggcagaaggaaaccgttgggcagatgctgaggccaaaattgctgccaggtggaacctcccattagaaataactatggaaggacccttggtatggagcaaccccaaccaagaggttaagccccagtattccctgactaaaagagaatggggactttcatggggtcctagttttcttccctcagggtggttaatgacagaagaaggaaaggtacttatacccgaagccagccagtggaaaatgcttaaaactctccaccaaacttttcatatggatattgaaaacactcatcaaatggccaaatccttatttacagggccaaatctcctccggaccatccgacagggagtcaaagcctgtgaggtgtgccaaaggaataatcccttggtccatcgaggtgaagctggtgcagcctctttcttcccctggcagagaccttggtgcaattcaccaagagctccccttacaattcctatcaatgtaggtgcttccatttgtcactggagtattgaaggacaagcttggtggtccagttctgctcatctttgtccactcaaaccagggttgaacaggaaactcatggcatgagagtcttggcttcctggaatcgcctagagtcaaagtaaaggatcatacacagcatacattgcagtcacccttcaggaggaaaaatagtgtcatccaaaattcatgtaaagtgtaagctctccttttatcttctgccatgattatgagttccctgaggcctccccagaagccaagcaaaagctgctctgcttcctgtatagcctgcagaaccatgaggcaattaaaccacttttcttcataaattacccattctcaggtaattagacatccagatacaagaagttgaaagaacatctggaagatgcactgcaagatgaacctgttcaagacctatagttatatcagactatccaaagtcaacatgaagaaaaaaaattctaaaagcagcaagagagaagtgtctaatcacttataatggaaaagccatcagactaacaccagacttctctgtagaaatcttatgagccagaacagattagaggactatttttaatattaaataaacagaaacaactgccaggcagtaattttgtatcttgacaaactaagcttcctaaatgaaggagaaataaagtcttttccagataagaaaatggtaagagaatatttcaccactagactaatcctgaaagaaatactaaaaggagttctaaacatgaaaacaaatgaatgatacaatcataaagcacatgaatgtacaaaattcacgaatcatataatgcacaattatgtaaagcacaaaaaatacacaattgagactataaagcaactaggtaataattaccattataacaggaacaaaatctcatatctcaatattaacattgaatgcaaatcaaataaatattctacttaaaaggtgtagactggcagattgcattaaaaaaattagatctaatgatatgcttacaagaaaccctcctaatgataaagaccttcacagatttaaagtaaatggatgaaaaagatattccatgcaaacagaaaacaaaggcaagcaggagtaactatttttatatcagataaaataggctttaaatcaacaacagttaaaaaaaaaagatgaaaaagtcactatataatgataaaagtatcaattcaacaataagttattacatacctaaatatatacatgcctaacactggagtagccaggttcttaaaacaaacaccacctgacataagaaaagagataaaaaacaagataataatagtaggagactgtaacatcccaatgatggtaacagaaagatcatctaggcagaacatcaaaaaaagaaatgacttaaactggactctggaccaaaaggacctaattagacatttacacaagattctactcaacgaatgcaaaatacatttttctcatcttctcatggaacttatccaaaatagaccatatatttggccataaagcatatctcaataaagttaaaaaaaaactaagattatattagataccttctcagactacagtggaatgaaactagaagtcaatactaagacaaatctcaaaactgtacaaatatatggaagttacacaatttgctcctgaacattctttgggtaaaaacataaaattagccaggtgcagtggctcatgcttgtaatcccagcaatttgggaggccaaggagggtggatcacttgaagttgagggcagtagtttgagatcaacctggccaatatggtgaaaccatatctactaaaaatacaaaaattagctgggcatggtggcacacacctgtaatcccagctactcggaaggctgaagcacaagaatcactcgatgatggggggtggagtttgcagtgagctgagatgatgccactgtactctagcatgggcaacaaagcaagaccctgtctcaaaaaaaaagaagaaagaaaaaataaatgatgtgaaaaatcaaaatataatttgaaaggaatgaaaacagagaaacaacatatcaaaatatgttacagatacagcaaaagcagtaataaaagaaaagtatatagcattaaatgcctatatgaaaaagatgaaaagatttaagtttcaagtgttgcatctcagggaactagaaaaacaagaaaaaatcaaactcaaagctaacaggaaaaaaaataacagagattagaccagaattaatgataatgatacaaaaagcactaagcaaagaatcaacaaaacagaaagctgattttctgaaaagataaacaaaatcagtagactactcactagattaacaaagtaaaaagagataagatccaaataagagcaaacatgaatgataaatgcaacattacaactgataacagaaataacaaaagatcatcagaaactactgtgaatatctccttgtgcccaatgagaaaaactaaaggattgataaatttctggaaaaatataccctcccatttttgagccaggtagaaataaaaatccttaacagaccgataacaggtaatggaattgaatcagtaataaaaacaacctaccaatcaaaataagctcaataccaaatgagttcacagccaaaaagagttcataccaatcttcctgaaatgattccaaaagataaaggaggaaggactcctccctaaggaattatatgaaaccggcgtcatcctaataccaaaatcagtcaaggacaaaacaataaaataaaactacaggccaatatccctgatgaatatggatgcaataatcaacaaaatcacagtgaattgaattcaatagtacttctaaaagataattcactacaatcaagtgtattttatcacaaggatgtaaggatggctaaacatacaaaatcaataagtgtgattcaccacatgaacagaattaaaaacaaaaaccatatgatcaccttaatagatgcaagaaaacattagataaaattcaacatcccttgatgttaaaaatccagaacaaatgaggcatcaaataaacatgcctcaaaataaaaaaagccatatatggcagatccagagtgaacatcatattgaatggtggaaagttaaaatcattcacactaagcactg

SEQ ID NO: 464264 - DNA, 1746 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggtaatcttcatctcaacagtgattgacctcactgtttcattaaccagcatctacagggcagccttggagatggactccaggatatgtgggaatataggatattcatgttcactagccacagctgctatctttctcttctctcctgctatccttcttcttcccatatcactattaataggcttgtttggctatcttgaaggcctccaggaattaatgttaatttagttgctctgcggacttctcacaagtataaattctttaaaaacat

SEQ ID NO: 464265 - DNA, 2707 bp, Homo sapiens
  misc_feature (286)..(286): n is a, c, g, or t
  misc_feature (422)..(422): n is a, c, g, or t
tttttccagtatagatagaaggggcctcatgcactagcccaagttctctgaattaatcttagataaattaaatactttgtaaatattttaatgattataattgtaataaaattattattttttctgttcctcagtggcgataaagtatttaacacttatctgtctttgcagacaagcatgaaactaaattgaaaggagtaatatactttcaagccattgaagaagtctattatgatcacctcaagaatgctaataaggtaaacatcagttttctaaattcctacantttgaatgcataattaagaagggaaaaatatttttggagtctaagaagtttgaaattgatgttctgatgtaacagatagatatgatcagaatggtgctggaaaagtaaacatgaagtaagtgggatggccgttctntttgaggaaaaaaaatatcatagcaaattgaggaaatattctggacataatggtttgggaaaccctgcgaaacgactctgccagggttctaaaaagaagctaccatatagttaagagggggatcgtgagcaagtcctagtagggctaagaataacagctactatttattaaactcctactctcagctaggtaccctgctagagctttacaaactagctgctgaaataatttatgagttctgtctgagatttcctgttcagaaaaatggtcaatcctgaaaaaggctctgggacaggtgtgtgagttatagtagagcaaaagtaacgcctttgtaaatttaataaattgaaaattttgaagaagtcatcacatgtctgtgttatttaatgttgtattttaagatgtttattttacattctttttccttttttgaattttagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464266 - DNA, 881 bp, Homo sapiens
tatttattttatacaatacaataatacattatagagaatattaagtgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgca

SEQ ID NO: 464267 - DNA, 548 bp, Homo sapiens
gactactactactaaattcgcggccgcgtcgacacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgca

SEQ ID NO: 464268 - DNA, 928 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacggtgagtgggctccggggacacagagtttctttgcttctttacaggctgtagggacaaaagcccgggctggggtcggcagtgcccaggctgcgcagctgggtgggtgggggtggcgaaccccgttgtgcatgactctcggggggctgggtagatctccggttgaggggatcccggggagggagtgtctggtagggaagatgcttccagagtgattgtagaaaacaggcagaatgtgggggaactgggggcaactttttccagcaactctggaatgcacatggagagagggatggggatccttgggatagctccctgagaaagagaaggtccgctgctggatggtgtagggcgcgggattcagagaagactccctccccgcaaatatttggctagctgcgcttctagttccactttctttcaagagtgaacctacgagctttaaccgccaaaagcggctgatttcgatttggcctttgaccccccactgaaagtttacagtgtggccgtctcggcacccctagagatagcagctggaaggcttggggagtattttaaccctctgtttctccagctccctgcgcggcggaggcgcagctgaatcgtttgctggttcgcttaataacttagccctagcagtcatcacttattaaagcgccgaggacctggctaactcccgccaccaccaggaaattaaaaggctgacaggctgtccctcccagggttggggtttcctgtttgaaagagcttgagaagtcaaactgcttcgcggttcctcacttacctttcttatgtaaaagag

SEQ ID NO: 464269 - DNA, 770 bp, Homo sapiens
  misc_feature (522)..(522): n is a, c, g, or t
tgaaagtgaaggcaagttaaacgtaagcaaagttaagaaggcgagatcaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaatcatcgatactggggggggagcggagctactatgctttcacagccattgaacaagtggttttttgatcacctgacgacacctaataagaattctaattcgtatctcctctttagcctatagaattactgactgaatctttcatttggtggcccccctcgtcagaaacccgcccggatctggatggatgttcaagtttccgcgggcataaagagtcactcacttgttgttggtatcgaactgtcgcgcnccgtccacttgccggcgcccaacggaattgaattgctttaccagcatacaatcccttatagtaaccgccatatgtaaaatactgcacaggactcctgctctttggccggtgcacgccttaccaccttctgtttttcatgaccactaggcctggtgtgcataattacacgacggggcgtttaatcgacccctcttcctaacgcggactaggcacgcattagcaaactctccgtggtacagaagttactg

SEQ ID NO: 464270 - DNA, 435 bp, Homo sapiens
cctgtacacttagataggagctttggaaacagggatgtggccatttcctaaaggtccattcagcctgcagcttgcctgaagtactccctcctgcttcccgcaggcccatctgcccctaggacagagtaacagctgtggaagtgtgctccctccctcactggcagccatggccaaagactcagaatctcggaggatgctcagaggatgatggtgtaagtataagccttaatcagcactgttaatagaactgacagcgtgagtcgtgcaaagaactttgagaggagagtttaaaacagagagctgagaaactcagcttctgaagttggaatggttattggcttttgaacaacttgtgaactattcctttgtcagctttagaatgaatgaaatctttgtccttttgttttttgttaaatacaggaaagtccaagaaag

SEQ ID NO: 464271 - DNA, 5602 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464272 - DNA, 6350 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagaggtgtgtaggcatgacgtttcattcattcactgcttttcttcatgtcagaaattaacccacggccaactgaaaatgaggtccacgagaacgtgcatgacaaatgtatatctgtttggccagaggggtagggtaaggctgagtttataaagtataccaatttgggggtaatgctctgccaataaaaaattctagaaaccatgaaatttatgctacggagtggagtactaggagaagtaagtcaaagaaatatgttctatgtcttagcactcttaactcaacttagttttcttataaattaaaaagcctttctaaaattgttgatttgagttgccttttcagtttgactttgttttcgattttgttttgtaacatggatgcttttaaatattaggccttttaaaagccttctaggggaggggtcaataataataaattaaaataccttcagtgatccaagtcgcttacagtgtgggattttaataagaggctaaattgaaagatattgcccatcaattgtaacttcttaattaaaatataacaaaacagaacaaactatcaatttcatttctatgtcttattctttcatttcatgtggacacatatataccttttctttctcctataaagcaaagatcacctgtctattctggatttgtgtttccttccgctctttctcctcatcctatcactcaacatacatcagccccatggcctgaattcatggctacatctgtcgatcctttacctttaaatgacacacctcctcctttaccagctaagaaacacagaaggcagcagcagcagcaggagcaacagaactgcccggaaggggagaaagtgcttacgtgctttgtccactggctgttctgccatccacatggcgaccatcataataatttctggtatgtagtggagtggaatgtgaacctatgcgacctgatgcccgcccaagctctccctcaggttctgccgacatgcctgaggggatcattgtggcaagagaagaggcaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464273 - DNA, 5304 bp, Homo sapiens
gactactactactaaattcgcggccgcgtcgacacactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464274 - DNA, 3740 bp, Homo sapiens
cccacgcgtccgccccacgcgtcgcagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464275 - DNA, 5801 bp, Homo sapiens
  misc_feature (5475)..(5475): n is a, c, g, or t
  misc_feature (5478)..(5478): n is a, c, g, or t
  misc_feature (5490)..(5490): n is a, c, g, or t
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaaanaanaaaaaaaaaaanaaaaaaaaaaaaaaaaaaaaaaaaaaaaaaaaaaaaaaaacaaaaaaaaacaacaaaaaaaaaaaaaaagaaagaaaaaagacaagaagcgagggagcggggcgagggatgagggcgacgcggcgccagatgtaagaagtgggcgggagctgaccgaggtgagtgtaagatgacatgtgcgctgcgagaggcagatggagcacagagcacggtgggcggcatcgctcgggcggagtgccggatcggacaagcgagactaacactcgactccgggcgctgagaaagaacgccagccggcagatccgatggga

SEQ ID NO: 464276 - DNA, 3182 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggtaggacctgggagaaaccacgggcttcccattccatgagtcttcttgtcattatattcactgatgtgtaaaggcctttaaagaaaagtgctaaataataaatcattacatttacttgttaggcagacatcaggactaaatctcattttctacctgttcagaggacatctgaaactgtatgctctggggccaaagaacatgcttcagggtattttctaccagcacaacccaggcgatgagtggcattcacttacatgatggacttccgtggctgcatcccacatctggagataagataggatgtagcctctgtgttccaggaataacagcaacaaatatttattcagacattttcatgtagctgacgctgggttgagccttttatgtggattgcttcatttga

SEQ ID NO: 464277 - DNA, 2078 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagaattgcatagttttgtgagcgacagaaaggaatggggtcaggcttctgggggctggtggtgattccagttat

SEQ ID NO: 464278 - DNA, 692 bp, Homo sapiens
gaaagtgcttacgtgctttgtccactggctgttctgccatccacatggcgaccatcataataatttgtaagttgtcctgaggccccaaggccgcaggcactacagaagtgaaaggtggaattttttaaagatttctaggttcagcataaattcctacagtgtttagtatctaatcaaatactagctcaaatctatcagtgaacacaatatatgttgaataactttaagaaaaattctgttaaaattccagttttttttgtaagtgcataattcttcatttcttcagtcacctattacagttagtcaagttttgctattttgctttgcatttgcatttaaagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggtaggacctgggagaaaccacgggcttcccattccatgagtcttcttgtcattatattcactgatgtgtaaaggcctttaaagaaaagtgctaaataataaatcattacatttacttgttaggcagacatcaggactaaatctcattttctacctgttcagaggacatctgaaactgtatgctctggggccaaagaacatgcttcagggt

SEQ ID NO: 464279 - DNA, 411 bp, Homo sapiens
gtccaatgactcgtaagtaacattctttaaattatatatgcttggattttgttatgcacctcccttgaccccatgtgtgtgtgtgtgtgtgtgtctggggtgtgtgtgtgtgtgtgtgtgtatgtattagagagacttctcagtctaaaccaatattctcaaaaggctttggtgtttcattcagtgccagcacttcaaatattgctagaatagaagaaatggagagacttttgaagcaggctcatgcagaaaagacgcggctgctcgaatccagggtaagcttcatattttcatgccggaggtctgtgataccgtggtgcaggagccctgcgcttggcatcagacaatactcctccttaaggagccgtgtgttcctggaataaatcactcaacctttctcagtctcatttt

SEQ ID NO: 464280 - DNA, 442 bp, Homo sapiens
tcttgtaggttatgtattataagagactagtctacaaaccaagatttgtctagtaagaattgtcttttttatattgattggaaccattcaagtataaccagtatgttttaaaataatcattgttatgcataatgtttaggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggttggtcggtcaatctgaatgcatatgggcaggttgccccctggtggcagttcctagaagacagctgttctgtgtctgaggatgctttcctgggcactgagcattagcacttgacatgtaagggttaagagaagagtgtgcattcctgtgcaaaaa

SEQ ID NO: 464281 - DNA, 6612 bp, Homo sapiens
gcaacagatggttccacagacatagcagatgttgcttttgaatccagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaagggctatatcagtgtaaatgagattaatgagccgtgtggcaattccacgaatctatccccttccactcagtttcctgctgatgctgatgctgttgccactgagcctgccacagctgtgctggcgagccagccacagagccccatggcctgaattcatggctacatctgtcgatcctttacctttaaatgacacacctcctcctttaccagctaagaaacacagaaggcagcagcagcagcaggagcaacagaactgcccggaaggggagaaagtgcttacgtgctttgtccactggctgttctgccatccacatggcgaccatcataataatttctggtatgtagtggagtggaatgtgaacctatgcgacctgatgcccgcccaagctctccctcaggttctgccgacatgcctgaggggatcattgtggcaagagaagaggcaggcccatctgcccctaggacagagtaacagctgtggaagtgtgctccctccctcactggcagccatggccaaagactcagaatctcggaggatgctcagagcgatcagagagcaagccatagcagtaacacaaggtaaagccagtaacctaaagtgccaggtgaccgagcaccagggtaaagaaaagacctcttggccgggcacggtggctcacgcctgtaatcccagcactttgggaggccgaggcaggcagatcacaaggtcaagagatcaggataatcctggccaacatggtgaaaccccgtctctactaaaaatacaaaagttagctgagtatggtggtgcactcctgtagtcccagctacttgggaggctgaggcaggagaattgcttgaacccaggaggtggaggttgcagtgagctgagattgtgccactgcactccagcctggtgacagagcatgactccgtctcaaaaaataaaaataaaaaataaagacctcttatttatggtgcttttcgtcctactgatgcctacattttcaaatggttgttatcaacagcttgtggaaggctgattgttatgatgggaaaagaagagagctagggtaattacgaggagcacagtcattggaaggaatgttgactctgaattaaataagtaattgacagacaagaacaactgaaaaagagagagagagaaaatgggaaaaatgtgtagtttggatcttaacaagattaaaagtgtcagtgatgatatgagatacgagtttctgaaatcctacacttgaaagattccacctgcttttttatgaccagactgagtgctccttaagttgaataccattgaagaagtgcctgccctaaaaccctggttttgcttgtcactaggaggcatcttattttcacttgaacacagctatttctagaggattcagggcctttgattgtgtttctgtttggtttcttttgtgtttgtgtgttgctggttgtgctgagatgtaggaatgccataggaaagtgtcaagtgatcctgctgaggggtaagagactcagcagaccacttcattcaaactgttgcttgcactgagcacggtgctctttctttgatcttcttggcttcaaaacaaattagaccaaggcccaagcttcataggcagatgtttctggttgctggcttgtgtctgtagatgtttaagattcaaagactgaaaaatgaggcaaactaacatatttatggctccttccttaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgca

SEQ ID NO: 464282 - DNA, 5473 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464283 - DNA, 5619 bp, Homo sapiens
taagctcggtaccccactttatgcgtgggtaaaggagaaactgtgttatgttcccaacatcccactctcttcagcaatcgctggaacagccatgggccatccctgctgagtcaggaaagaagctgagtggaagagtcgggattgaaaagcagcagacaaggctggcactgatcccagtttatcctttgagattcagcagaagatcctgatggaggaggaggataccaagagagaggtgcccaaggaagatggagttggtgatgtgcaacatttcgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464284 - DNA, 6327 bp, Homo sapiens
  misc_feature (3657)..(3657): n is a, c, g, or t
  misc_feature (3793)..(3793): n is a, c, g, or t
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataaggtaaacatcagttttctaaattcctacantttgaatgcataattaagaagggaaaaatatttttggagtctaagaagtttgaaattgatgttctgatgtaacagatagatatgatcagaatggtgctggaaaagtaaacatgaagtaagtgggatggccgttctntttgaggaaaaaaaatatcatagcaaattgaggaaatattctggacataatggtttgggaaaccctgcgaaacgactctgccagggttctaaaaagaagctaccatatagttaagagggggatcgtgagcaagtcctagtagggctaagaataacagctactatttattaaactcctactctcagctaggtaccctgctagagctttacaaactagctgctgaaataatttatgagttctgtctgagatttcctgttcagaaaaatggtcaatcctgaaaaaggctctgggacaggtgtgtgagttatagtagagcaaaagtaacgcctttgtaaatttaataaattgaaaattttgaagaagtcatcacatgtctgtgttatttaatgttgtattttaagatgtttattttacattctttttccttttttgaattttagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgca

SEQ ID NO: 464285 - DNA, 3746 bp, Homo sapiens
tagctgattcttgaggaaaactgtcatccgcgattaaagaggtgtgtaggcatgacgtttcattcattcactgcttttcttcatgtcagaaattaacccacggccaactgaaaatgaggtccacgagaacgtgcatgacaaatgtatatctgtttggccagaggggtagggtaaggctgagtttataaagtataccaatttgggggtaatgctctgccaataaaaaattctagaaaccatgaaatttatgctacggagtggagtactaggagaagtaagtcaaagaaatatgttctatgtcttagcactcttaactcaacttagttttcttataaattaaaaagcctttctaaaattgttgatttgagttgccttttcagtttgactttgttttcgattttgttttgtaacatggatgcttttaaatattaggccttttaaaagccttctaggggaggggtcaataataataaattaaaataccttcagtgatccaagtcgcttacagtgtgggattttaataagaggctaaattgaaagatattgcccatcaattgtaacttcttaattaaaatataacaaaacagaacaaactatcaatttcatttctatgtcttattctttcatttcatgtggacacatatataccttttctttctcctataaagcaaagatcacctgtctattctggatttgtgtttccttccgctctttctcctcatcctatcactcaacatacatcagccccatggcctgaattcatggctacatctgtcgatcctttacctttaaatgacacacctcctcctttaccagctaagaaacacagaaggcagcagcagcagcaggagcaacagaactgcccggaaggggagaaagtgcttacgtgctttgtccactggctgttctgccatccacatggcgaccatcataataatttctggtatgtagtggagtggaatgtgaacctatgcgacctgatgcccgcccaagctctccctcaggttctgccgacatgcctgaggggatcattgtggcaagagaagaggcaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 464286 - DNA, 2584 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagaggtaagctatgattttacatgtcgctttatgttgccttagaaatcaggagatgtatttcagctttatttgattagctgaataat

SEQ ID NO: 464287 - DNA, 1640 bp, Homo sapiens
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggactgagatcgtgccactgcactccagcctgggcgacagagcgagactccatct

SEQ ID NO: 464288 - DNA, 1662 bp, Homo sapiens
ctgcactcggagcagccggccggccctgccggacccgggcaatgaggggcttagcacccgggccagcggctgtggagggtgtactgggtcccccagcagtgccagcccaccggcgctgcgctcgatttctcgccgggcctcagctgccttcccgtggggcagggctcgggacctgcagcccgccatgcctgagcctcccactccctcagtgggctcctgtgcggcccgagcctcctcgaggagcgccatcccctgctccacggcgcccagtcccatcaaccacccaagggctgaggagtgcgggcgcacggcgcgggactggcaggcagctccatctgcagccccgctgcgggatccactgggtgaagccaactgggctcctgagtctggtggggacgtggagaacctttatgtctagcccggggattgtaaatacaccaatcggcactcagtatctagctcaaggtttctcagggattataaacgcaccaatcagcgccctgtcaaaacagaccactaggctctaccaatcagcaggatgtgggtgggggccagataagaaaataaaagcaggctgcctgagacagcagtggcaacccgctccggtgtccttccatgctgtggaggctctgttgtttcgctctttctactgcttactcttcgggtccacactgcttttatgagctgtaacactcaccctgaaggtttgcaacttgactcctgaagccagcaagaccacgagccccagggaggaacgaacaactccagacgcgctgccttaagagctgtaacactcaccgagaaggtctgcagcttcactcctgagccagcgaggccacgaacccaccagaaggaagaaactctgaacacatccgaacatcagaaggaacaaactccagacgtgccaccttaagagctgttaacactcaccgcgagggtccgcggcttcatttttgaagtcagtgagaccaagaaccaaccaattcgggacacaataccaactctttcatgccaggagaagcctccttaaaaaatttcggtgattaacagcagcacatgggtcaaaatctcctgaaagttgagcaggggagctgtagaagaattcctccttttctcgcagatgaaatcttatgatatagcaggggttacctggccaagaaggaacacagaggagaacaaagaaaattcaaggaactaaattccttctccacctcaaccaccagcattgatactccatcacttatgtactgcatcaagccgtcctcagaggtgaggaaggtgctgtcaagactagaagcatgtgtccctctctccattgcaagatgggacatagagaggagaaaagtggcagacagaagtcttaggtatgtctttatcagcagcatgaaaatggactaatacagggaccaatgattgcatctacctcatggactttttatgagaattgactgatttaataaatgtaaaagacttagaacactgcctcatctattgtaaacagtcaataaatattagtatcaattttcattgaatcctaatcagtataactataatgttacattcatgaataagacaaaggctgggacaaaataaatgagacacttcactcagacctcttcattgttttcccagttgtcatcctttgcacctagttctgtaatt

SEQ ID NO: 464289 - DNA, 1511 bp, Homo sapiens
  misc_feature (489)..(489): n is a, c, g, or t
  misc_feature (491)..(491): n is a, c, g, or t
  misc_feature (493)..(495): n is a, c, g, or t
  misc_feature (497)..(497): n is a, c, g, or t
  misc_feature (499)..(499): n is a, c, g, or t
  misc_feature (502)..(502): n is a, c, g, or t
aaaaaccatatggaagttatcacacacactctcaaggaacaattccacatttcacatcacagcacgcttcacaatgtcacttcaaaggggcacacattttatctgattattcgtagcactgagaacctgtgtctaacaggacctgccaatctgtgtcacgctggttctcttccctacctttttaacgctgccctgccctcctctcctcctgaccccaatcctctttatccacaagagattggcaccgttgtcctcacaaacggtatagctgaatccacagagtcatccctgattcctttcctcccctcgcctccacatggaaccactgcaggccaaactaacggtgactataggccctgtgtccggcataccccggctgcggcccaagcctctgagctaactcttccacctgatgttccagttaccctggacttcttcctgcaacttaggcacatctggctgtcctcaccagggcatttgttcccttgntngnnncncnctntccataaagatatcagcacataagaagaacattcatgaagagaccttaaaagcagatgcttggtgcaaaagtactcatgccaagagattctctaataatgcgcaatgcatcacctatctcaaaagaggctccccaaaccctcggatttattaggactaactggccggtctcttactctccagacaaaatttctactttttctctctcaagttgcaaaacaactatttctaatgatggattaaaaacctgaagctgctattccattatgaacctctatctagtagctactgcaaactgctcagctcctttgcttgaaacctccaggagggctctggtgagtaagaaaagcagaagaaaattgcttccgggattgctgggtaagaactgcctctggtgctctctggagcatactatctctttataagaagcagacaaaccaggagtcaggggggagttcacatcaaatcaccttcagaagctgtcaacagtcccagagaactaccttagtggacggaaagaaggatgcggaaaaaggagagatgatgcagccttgctttacgtttgcaaattggataaataaggaaaatatttaattctttaaaaaaatgttaaataaatgggagcttttcaacttgaggagtgcactgtaatagagtgattacatgaagggagctctgaaaaactgccaagactttctttgccatgtttttataatatttatgcataagtattggttgtatgtgttataaataccttaaatttgttggtagttttgaggattgagatatcatatttataccattatttagaaaggccttgagtattttaaaactatattgttaccagaaaagtataaataaaggtacatgtcatgaagtgctatattcttgagtgatgagacttagacactatcctcatcttctaagattttatagtgtaagacatcatggctaagatattctctattttgtagcaaagagaaataggatgtttctgtaatcattgcttg

SEQ ID NO: 464290 - DNA, 1414 bp, Homo sapiens
  misc_feature (489)..(489): n is a, c, g, or t
  misc_feature (491)..(491): n is a, c, g, or t
  misc_feature (493)..(495): n is a, c, g, or t
  misc_feature (497)..(497): n is a, c, g, or t
  misc_feature (499)..(499): n is a, c, g, or t
  misc_feature (502)..(502): n is a, c, g, or t
aaaaaccatatggaagttatcacacacactctcaaggaacaattccacatttcacatcacagcacgcttcacaatgtcacttcaaaggggcacacattttatctgattattcgtagcactgagaacctgtgtctaacaggacctgccaatctgtgtcacgctggttctcttccctacctttttaacgctgccctgccctcctctcctcctgaccccaatcctctttatccacaagagattggcaccgttgtcctcacaaacggtatagctgaatccacagagtcatccctgattcctttcctcccctcgcctccacatggaaccactgcaggccaaactaacggtgactataggccctgtgtccggcataccccggctgcggcccaagcctctgagctaactcttccacctgatgttccagttaccctggacttcttcctgcaacttaggcacatctggctgtcctcaccagggcatttgttcccttgntngnnncncnctntccataaagatatcagcacataagaagaacattcatgaagagaccttaaaagcagatgcttggtgcaaaagtactcatgccaagagattctctaataatgcgcaatgcatcacctatctcaaaagaggctccccaaaccctcggatttattaggactaactggccggtctcttactctccagacaaaatttctactttttctctctcaagttgcaaaacaactatttctaatgatggattaaaaacctgaagctgctattccattatgaacctctatctagtagctactgcaaactgctcagctcctttgcttgaaacctccaggagggctctgacaaaccaggagtcaggggggagttcacatcaaatcaccttcagaagctgtcaacagtcccagagaactaccttagtggacggaaagaaggatgcggaaaaaggagagatgatgcagccttgctttacgtttgcaaattggataaataaggaaaatatttaattctttaaaaaaatgttaaataaatgggagcttttcaacttgaggagtgcactgtaatagagtgattacatgaagggagctctgaaaaactgccaagactttctttgccatgtttttataatatttatgcataagtattggttgtatgtgttataaataccttaaatttgttggtagttttgaggattgagatatcatatttataccattatttagaaaggccttgagtattttaaaactatattgttaccagaaaagtataaataaaggtacatgtcatgaagtgctatattcttgagtgatgagacttagacactatcctcatcttctaagattttatagtgtaagacatcatggctaagatattctctattttgtagcaaagagaaataggatgtttctgtaatcattgcttg

SEQ ID NO: 464291 - DNA, 734 bp, Homo sapiens
tctcctcatctgctcatctgcttctggagcctggggttcagggtttatatgggtacaggatggaggggcatggcgagccaaaaggcaacttttggggcacataatgcctgttcccacttacggccacgggtctcaaggcttgagggttgggactttgctggggaaccaccctcttctacccaatatttccctgtcttctgtccatatcaaaattaccttctctcctccacaacagaaatcagggttttcccctcttccttcccagatttatctctgtggcaagtatttttgtctccagaagtcctattctcattgcccagccaaatggctaaaggaacatcaccccaccagctgacctttgaagaatcctctcaacttatggatactaatccatcagctgcaaatagccacacaaatgttcaccacatgcatatacaggactatgaagctttgtacgatatggagttgtattagggactcagacctgggagaacagccactgcccagacacgttcagcgacagataaaacagtataacattttgcaaaggcaaattcctcctcttctgctgtagaaaaacttggtttcttcttcatacacactgagtccttctgctcataatgctggtcctaaacaccttaatccaaaagcagccaataaaaagtttttaaaagtccaactccttagggaaaaactttgttttccagtttgtgtgactcaggtcatcagctcac

SEQ ID NO: 464292 - DNA, 442 bp, Homo sapiens
gtgggtgattgcagaagatagtcaggtaagcttggttgtagaacaccgctaactattttgtgacctttgaagaatcctctcaacttatggatactaatccatcagctgcaaatagccacacaaatgttcaccacatgcatatacaggactatgaagctttgtacgatatggagttgtattagggactcagacctgggagaacagccactgcccagacacgttcagcgacagataaaacagtataacattttgcaaaggcaaattcctcctcttctgctgtagaaaaacttggtttcttcttcatacacactgagtccttctgctcataatgctggtcctaaacaccttaatccaaaagcagccaataaaaagtttttaaaagtccaactccttagggaaaaactttgttttccagtttgtgtgactcaggtcatcagctcac

SEQ ID NO: 464293 - DNA, 3621 bp, Homo sapiens
  misc_feature (3)..(3): n is a, c, g, or t
  misc_feature (5)..(6): n is a, c, g, or t
  misc_feature (8)..(9): n is a, c, g, or t
  misc_feature (11)..(12): n is a, c, g, or t
  misc_feature (14)..(17): n is a, c, g, or t
ttntnnanngnntnnnngggtgtggaaacagctctgcaccccttcttgattgctgaacactatgatgtgaatatttctacatagccaccacctttatcatttttagtgacagcttaatataccatagggtggatgcctataatttccttagacttcgttttgaaacaacatagctcatgaacctcttcaaagatgaataatgagaaagcaaaaccttctgcttcgttatagaaggaattacccaatctctcccctatcttgaaaaagaagagtgttcaccacgtggccacaacgagaggagagatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgaggctgcaggtcaggaagtccaaggtcaaggcactgactgattcggtgtctgcccatgcccgcagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagttacagagcggcctgtgagcatgagcttcccgctgtcttcaccccgcttctcgggcagtgccttttcatccgtcttccagagcattaacccctcgaccttcaagaagcagaagaaagtcccttcagccctgacagagtacccaagcagactgcacagatcacgggggctcttcattctaaaggagccaaattcctgtgttggtccttccatgtcatcccctcatcctaggggtcccaacccggctcaggtggctgcctctggagagggctctgccatcagtggctatctcagccggtgtaagaggggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttcacactaagtgattagacagtgttcttgttaatttttgagggcttaattccaactgaatcattttcatcatcagacactgaaatgggcttcctagagctgtt

SEQ ID NO: 464294 - DNA, 1800 bp, Homo sapiens
tagctgactcctgagggtaaaccagcctgcggaaaacgggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttcacactaagtgattagacagtgttcttgttaatttttgagggcttaattccaactgaatcattttcatcatcagacactgaaatgggcttcctagagctgtt

SEQ ID NO: 464295 - DNA, 1637 bp, Homo sapiens
tagctgactcctgagggtaaaccagcctgcggaaaacgggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcagggga

SEQ ID NO: 464296 - DNA, 3510 bp, Homo sapiens
  misc_feature (3)..(3): n is a, c, g, or t
  misc_feature (5)..(6): n is a, c, g, or t
  misc_feature (8)..(9): n is a, c, g, or t
  misc_feature (11)..(12): n is a, c, g, or t
  misc_feature (14)..(17): n is a, c, g, or t
ttntnnanngnntnnnngggtgtggaaacagctctgcaccccttcttgattgctgaacactatgatgtgaatatttctacatagccaccacctttatcatttttagtgacagcttaatataccatagggtggatgcctataatttccttagacttcgttttgaaacaacatagctcatgaacctcttcaaagatgaataatgagaaagcaaaaccttctgcttcgttatagaaggaattacccaatctctcccctatcttgaaaaagaagagtgttcaccacgtggccacaacgagaggagagatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgaggctgcaggtcaggaagtccaaggtcaaggcactgactgattcggtgtctgcccatgcccgcagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagttacagagcggcctgtgagcatgagcttcccgctgtcttcaccccgcttctcgggcagtgccttttcatccgtcttccagagcattaacccctcgaccttcaagaagcagaagaaagtcccttcagccctgacagaggtggctgcctctggagagggctctgccatcagtggctatctcagccggtgtaagaggggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttcacactaagtgattagacagtgttcttgttaatttttgagggcttaattccaactgaatcattttcatcatcagacactgaaatgggcttcctagagctgtt

SEQ ID NO: 464297 - DNA, 1748 bp, Homo sapiens
tagctgactcctgagggtaaaccagcctgcggaaaacgggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcatctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttcacactaagtgattagacagtgttcttgttaatttttgagggcttaattccaactgaatcattttcatcatcagacactgaaatgggcttcctagagctgtt

SEQ ID NO: 464298 - DNA, 3603 bp, Homo sapiens
tcttttcagcaggatgctagtctactggtaccaatttaatgtagtagttcattttcactctgttgataaagacatacctgagactggaaagaaaaagaggtttaattggacttacagttccacatggctggggaggccatgtggagaatcatggcagatggcaaaagacacttcttacatggtggcagcaagagaaaatgaggaagatgcaaaagcagaaatccctgataaaaccatcagatctcatgagacttgcccactaccacaagaatatttggagggctcagaagaagacaggaaaatgtgggaaagtttggaacttcctagagacttgttgaatggctttgacacaaatgctgatagtggtatgaacaataaattccaggttgaggtagtgtcagacgaagatgaggaactttttgggaaatggaataaagatgattcttgctatgctttagcaataagactgggggcattttgcccctgccctagagatctgtggaactttgaacttgagagagataattcagggtatctgacagaagaaatttctaagcagcaaagagttcaagaggaagcagagcataaacatttggaaaattcacagcctgacaatgtagtagaaaagaaaaatcctttttctggggagaaattcaagtctgctgcagaaatttgcggcagtatggaagagaaatgtgaagctggagcccccacacagagtccccactgggcactgcctagtggagctgtgagaagacggccaccatcctccagacccgagaatggtagatccactgacaacttgcaccatgtgcctggaaaagctacagacactcaacaccagcctgtgaaagcaactaagacggggactgtactctgcaaaaccataggggtggagctgcagaaggctgtggaagcctacctcttgcatcagcgtgacctggatattcatcagctccctaaactgtttgcctctgcttaatctcgtaggacacaaatcaataacacaggcaatttgggaattaggaaaaggactgctgaaggaggaaaaggttttaccaggatatacctgtgtaataaacttcaagtttatgaaattgtgggcatagttcacaagaaaatgtcacatatgctatgtaataaaaaaacttcccatttcaaaaaaaatatttaagatcccaaagaaaaagccattgagaggtagcatgatgtaactgctacatttgaagtactggaaaaaatagaatttggttgaattccaggtctgccttttgctgataacataaccttgaggatatctcttagcctaagctgtacttcactgtaatgaaacctgagaataacatgtgcctcatggagctgtcgtaaggaatcagttgattaattgagaattctacgctccagcaatagcagagatagatgacacaaatgacattcgcccgcccatggctgcccatggaccaattggcatgtgcttccttccctctgaggcccatagaagccctggactcaatctgactcaaggagatgatgggactacaagctgcggaaaggagctacccactccaaggtctctgctgagagctgaacactcatcaagacaccctgcctgcagggaggagttacccaatgcaggtctcctctgagctgttccattgctcaataaaactcctctttgccttgctcaccctccacttgtccgtctacctcattcttcctggacacaggacaagaactcgggacctgcaaaagggctgtaacacaaacagggctgaaacacatcccttgctcgccatattgtaggtgacaagaaggagagacaagagaaggagagaagagctgcagcccttctgggagcccaggcctaggagatccctgagccagggctatgacaccctctttggggctctatggttcctggtgtctccaagcttccggatgccactgcattcctcagtgccagccaaagttccctgttttctctattttacatactgtgtgctgacagcagccaaaagaaaaggcgatagctcacattctagtgaaaccttgggttttgtggctcagagtccagttgctaatagctactctttttttcattgttttaaaaactagtggtttttccttcagtttcccacggactgaaattattgattaaatcaacttggcatggtttcgtatgttacttctgttacagatttttcttgtaaattagatctgcagtattcgtcagatctaggactgatattttgcaagactacattgtaggccgttttttaagttctgtgagaaggcatatgatgtctgggggactttttctatggtgttagccttgctgatcaattacatcattagatgcattctttcatcagaagtagaaaaactgtgatattctaattttcttattatatttttatgtataagctagaatacatctataaagaaaatatcctcttcctgacatttggaaaatttgaggtattattcataaaggagagacagaaaaaaaatgctacattcttattaattatttttcaaaataatgagttgactacttagaaaagagatcagaaagctttttttgtgtagggaaaaagaaatttattttattcccatcttatgttcatggccgaggcctttataacacaagagattaactagagaaaagcatggaaagtatttaacagaagttttatgtgagacagatgtcttcataaggaaatgaagacccgaacaaacagctaaacctgtgtgtttctatactaagttttatgaagaagtgggtagatgcagagatgtatgattggacaaaaggggtataatctaatgattaaaaactctgagaacttaacagggcttttttgttcctatccttctgtatccctgggtcttcagagataaggatattccttacgtttgggtataaggtgggcacttctcacatggtctgaagatataactcagatgacaagggcagggaaaggtgatcttttacttctgctgttttctcaaataccaagatactatattttgaggtagtatgtcctgaatcctattacttgctaagagccaattgtaaatcttttaggctttgtaagccatacagcctctgtcacagctactcaactctactgatataaccagaatgcaaccatagaaaataatgtaaacaagttggtgtattgtgtttcagtaaagctttttttttacagaatcagaaagctagacggattagactcacaggtcatcgtttccaatctgtgacttagaatatcttgaaaatcaccaagaggttttttagtttttatattggcttttatttagtattttagcaacttgtttcatttagtgtaaaagttgttacagtgttttgggcttcttttttaagagacattttagacccagtgcaaaatagagaggaaggtacagagatttcccatgcaccccctactcccacacatgcccagcctctcccattacccacagccccaaccaagtggtgattcattacaatcgatgaacctatattgacacatacctgtcacctaaaattcacagtttgcattagcattcactcttggtgttgtaatgatttgtattcat

SEQ ID NO: 464299 - DNA, 749 bp, Homo sapiens
tcacacatatgcacaaaaaacatacagagagaaaacacacagacaggaagcacacacagaggaaatacacagaaaacacagtcacacacactcacagaaaacacacaaagacacgcacacacgtagctggagatgagcacaatatagtcctctgtttcacaaaggacggcccttgtcagcagctctgggccacattccggggtcaggtgaagtggacagtcctccacgccccaactccaagcgcagggatgctctgtaagagaagacactctgctaagcgcagtgctgcaagactcatgctaaaatctatgtgtacatatttctccaggcccctcataagatcatcacaagcaacacagagaaatgttggcctgctgaaaatagaagtgcagagactctctcccgtgacagaatgaggcgtggaggattcgcagaactgtttcctcaagggccccatagtgataccgtcttttattccttttagtagcctcatcagtgccctgaatgcagtgacttgtgtcaggacagcgttctccatgctggctgcgggtgacggcctgagccccggtacagtattcctgctggcctcagaccgccctcccaggcaaaacctggggccagcctgtctgcagtctgaaatgccctccagattatcctaaatgtgcatgttaatgaccatcagatctgagagctggtggagaaattaagataaatagagaaaatcctgactgtgtttgctttggaccaca

SEQ ID NO: 464300 - DNA, 3815 bp, Homo sapiens
ggtacatatgcgcaatgtgcaggttagttacatatgtatacatgtgccatgctggtgcgctgcacccactaactcgtcatctagcattagttttattgaatgaaaatgaactaaaggcataccttggagatattgtaggtttggttctaaatcacctcagtaaagtgaatatcacaataagaaatgttgccaatggcattaagggcccaattatgctgttgggcagtttcttatttgctgctaacttatctaaaagttcacctattttagctctaacatgcttttatcattttgtccattgtgaggtttggggaaaaacaaacgaaaacaacgaccagaatgtgtatgcgtgcctctgtgtgtgtgtgtgtctgtatgtgtgtgtgtacatctgcattcctctgtgtgtctgtgtgtgtgtgtgtgtgtacacatctgtgtgtgcttgtacaattggttctgagtagctgtatttccacttactttactgtttgtttttatccttgaaatgcattacttttgctaatataaatatcattctgtaaactgacactttcatgcaggctttttaaatgtgctgaatttataactattattagtggaagacaatacataattatccaacttcatactacaacacattctgaaagctttcggaaagattggaacatattcaaattacagtttacatcaacataagtcaaccattcatgtattttcattctagcttaaagcaagctggcagacctagcaggaaccttactccaagtcacaaacaacttaatttgcaggccaaagaaaatctctatatcagtagggaactctgttgcaatgacttggcatggttaactaaattcacaagagaaaatatgtacaaaggtttaaagattacattcaaatgaaattttttgtgccagttgaatcggatcattacactagaactgagacacaataagtattttcaaattaacctaaccgtattacagattcaaataaagtatcacattaccacagcccaatattcctccagtcactacttaatgtttaatttctaatttctcctgtgggttttcaatgttctacctaatgtactgttcttccttcactaatattaaacttggttaagagattcgctaatagtgattcagttagttccagttaaattgatttaaataaaatataaatgctgtgacatagaaaataatgtaattgatacttagaaaaataaaaatgtatacaaattgctaatacaagaaaaatgatatgatatagtttggggtctgctcatgatcaattttatggtatttgggaatcatcaaatttagctgagtttatttatgtatttggaaaattaggaagaatgggcttgctactcaagtattgtccttagatcagtaatattatcatttggaattgtgacaggaagattatcttagatcctctactccaggcctactgagtcagatctgcatttaaacaaaatatcaggtgagctgactgttcattgacttttgagaaaatcttgacctagaaggcttcaatcacttttatttttatcacttttatctgtttctctgtctcttggtcccaatcacaggtcttatctgaaaagtagaataattatcatagctggggtttcttctaataaaaacaatgataaatgtaagttctatttattgcccttttatgaagttgtctgtagaagacagaataataacaaacaattaatgtatttccattataacattaaaatggctttaaaatttggaaatttggtcagtacttatttcaactagttataatttgatatgcattatataaagatctgataactatttctaggaacatactttttctttatagcattctaattttgcagcatggaatatgtggcaaataggaagtaggatatactttattaattattatttaacaattaattttgcacaaattggttgaaaaatacataaatataaatgttaaatacacaaattaaataattaaactagaatatagtggttctatcattgcagtgattcttgtttacttttctgtaactacttacagatgaacatacactgacactcacattcctatgtatatatggtcacttaatatttagcctacaaattaaattcaaatttatattttctgtttcccaatcatatatttgaaaatggtacacatgacacaaattcttaaggacattaaaaaatctcatattaagaacaaagctttatgttaattttatatttcacatatgctaataatatttatttttcttgtttaaatatatattcagatatcacaaagaatatttttcttatataactttccaggctattcagcaattcttaattataagaactgagtattaaaatagctttacttattaaagatattttaacatctttaatgggttcaatgctgtttcttttttttaattttaaaattatctacaaagtaaacttttgcccatgtggagaattacctgggaatagataacatgatgcatatttagttttaaatgggtgttgttgacatttgtaacagaaaatatcaaatgcggtaacactatcttgaattattctgaattatcaatcatccatgccaattaggtaatgacttcctattaagattaatggaaattgaatgtaaatctccatgaataaaactcaggctatacaaatatcccaattacttagggcttaagtgtctgtgatactcctcctttaaagaaggcaaacgtgtttactagaagcccttggctaataataaagcaaattttaaagtagtgcttaatggatatggtcagaaaaaaagtcctgaattcaggaaaacaagctagttgttagactttaaagcttctggaatcagtgttgcatcctgccatccctagaaggtcacattttaactgagtgtgttttagcaaaatcatcctgtagaggaaatgattggtagtagttcagaaaaaaaaatgtattatagttctcacattcaaaataatttcttaagaaaaagatggtataaattctgatttcctattttccctttatttacttctctgtcctccaacttttcacctgaatccctggattttcttagattctctaggctgtatgcatctcttcccttcaacctgcccacccagttcttcatcaactcttccgtttcctctatttaaatcattcctagagttacataaaaactcaactattttattcttaaataaatatttctatttatttatataagttttgattgtctctcgtgtgagcttaaggaatgagtctttatgttctagtttctactcactctaaaatatgtcccacaagctagccagttttcctgccaaaactaatatttgattatattgctccccttaccagcctttagaccttttctaatacaaactcttttatatcacattcaggactttccacaatctggtagcaatctccacttccagacttcaatgaaaatgtcttctttatgttctaatctcagcaaaagctgatcgttctcttgagtaagaaatgcatttataagcttcaatttttttccttagtttccctctgcttacttctattgccaccaactttgtttgaaagcactaattaattgtactttgttggaagcttttcatttcatttcattgttcatttatttatttgatcatcaagcacctaccacaaaatagccactcaaattatgtgttttcaattaatgaaagactgcagattataatttgtagataatttcttagtctgattaaaatatatatgacatctggttccaaaattgtggcatagaag

SEQ ID NO: 464301 - DNA, 1646 bp, Homo sapiens
agcagcacctggaatacttctcacagtgctgtttgtttgtggagtttcctagcgggagaattaggaaagatatcatcaaaaggttccttctgaaaacattccagttccctttaagtatgcctttggtgttgtggattctagaatgctaatctttgtctctccatgattcccacatagcctgggtcctggataggatttagattccacagatactctcacagtgccatttggctgtagaaaagaactaaatgtgaagaaaagcaggatataaaacatttatttgctggcatgtatagaaatataactggtgtcattctgctgtcagcatgtcagaagattttagacttttctgcagtggttatgaaagctttaaccatgttacaggggcagactgatactggagtttgaaagctactcttggagacatgggctgcctactattttggccttccaacaattttataagaaactcaatagataacgataaataccttcaagcttaaaatcgcgattatgatttctgctgtgcgcaatgaaactctgagtgaaacagtcctccaggattttgaagtcctctgcatccgggcagtggaacagaagtgtggagaagattcatcatctgcttcttaaatgccctagtcagaaaggggtactcatcatttctgttcatattttatacggctacaaatagatgtgagaagagcaagaaaacatagtcctggcaaggcagttgccttctgatgacaactctgcactctggaggtagacaaattttggtcaatagctggcagttttagccatattagtccagtactcaccttcacaaatgaggaaacttaagactcggccattaacagagacggagccagaaaagggtgatgaagcagatttacaagaccggctctcagaaaatttgcttggacatgcagaaccatgctttcaagtactattgttaccaacgcgaatctgcagcgaaagtgatccttgcctctctggaggacagaatttggctgaggggcagaatgcatgcttgagcccactagcccaatccctgagatcttatcgggaagctgctgctcctccacagctccaggagtttcctatttattgggagactcctactgaaagtaaagacaagaatgaagatttttatgacgatccacctccacctaatgggaaatacattttcttttctcttcctaatgattttctcaataacattttctttcgcttattttattgtaaggatacagtatttaatacatataaggtacaaaatatgtgttaatcaactgtttatgttatcagtaaggcttccagtcaacagtaagctattaagttgtaggggaatcataagaggacactattttatgaaacaaacctagagtcagaaaggaagtgaagttggtcccaaacttcttggaggctttgttagttttttaaattcttttttcttcatctttgatggattgaattaattcagaagccttgtcttcgacctttgaagttctttcttctgcttgttttattctattgctgagattttccagtgcattttgcatttctctatgtggtccttaatttccagaatttgtgtttgtttttaatttatgctgtttatttcactgaagacttttcctttcata

SEQ ID NO: 464302 - DNA, 1209 bp, Homo sapiens
agacagccacacccctgagccctgccagagcacctgaggctcactcaatgcaattccctgatgctaatgcaagagggaggctctctgcagtatcagatgaaacttcaaagagaagtccacaggaatttgtggcaattggttctggaagctggatcaccaattcttggctgtggcctaaaaggagaaagcaggaaaatctgcagaacagatccagccctctgttacctggccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggatttggtctgagaatggctaccaggaggagaacagaggagggaccaacagttgttggagatgctcgtctatcactgaaaggttctttcctgcatgaagaaatgatttaaatcaaattcatattttttttctaagtaaaccttgtttattagttagcttgggctgctgttaccagagtgccaaaatctgtatggctgt

SEQ ID NO: 464303 - DNA, 1233 bp, Homo sapiens
ttggatccttgcttacaaatcatgtcacctgtatattttcatgttaatattagtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtgtctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacatctgtggctactcagtaagaaaaactcagttttccttacaaaagaataataatagtagaagtgatgatggtgatgatgatgatggtggtgatgatgaggatgaggatgaagatgaggatatagatcaatgacagcccctgacaataaaaataaaaatggaaatcagaatgaacatgtttaaagtatagatgaaggtggagacacttgacaatgtgaaattgggaagcactgaggaagttggatcaagtgaaaggcaagacaacatgatctggaagaaactatataacccagagaggaagaggaagggaaaggcagaaaaagggaagggagcattcttggcagtctgatcatgaaggattcctggttgtcct

SEQ ID NO: 464304 - DNA, 2298 bp, Homo sapiens
tcatcagttaaggcaggaacaggccattttcatttcttttgtggtggaatgtcatcagttaaggcaggaacaggccatctggatgtgtacatgcaggtcacaggggatatgatggcttagcttgggctcagaggcctgacacaattacctctgcaatcatggaagccagttattatctgccttatttctttcctgagaaaattaaatctcaaataagtgcatctggcagtagacctaaagtcattgaaggtcagcaaagccatcagtcggggaaaaaatataaaagtgaaattggggacggaaaggaacaactggaatctgtaaagaaaaaaaaacctatgagggaaactggaacccacatctgcactgcctccaacatcagcaatgcagttggccatgaaaagaagatgatgtcctttgccacaaggctaaatgctaatctggttcaagacttagagaagatgaaagaggaaatccatgtgggagataaattggagtatgctgagaataaaagcaaggagaagatttgggagcctgctgccactgtctataagaaccatagtatctctgaaatagcaaacaggaatcctgtgaagagagtggggaaggaagagcccagtgttgagaaaagtggttttggggaaaactcttctcagtggtggcttttgagcagagcctggcgtctaccttggtttactagtatgtcccgagctctaactgctacccactgaaatactaccaccctaagccattcaaaagactgcagccccagccaagagtttgatgtaacctcaggagagaccctgagccagaaccacctagactgacaacctggcaatagtgactgcatggaaagtggcctgcagctctaacccatattccatcagagccctttcctctagagttagtccataatctgtattggctgttgttttttccatatccactcatataacaaatatttcaggatgtaaagtacatctttttctggaataagagcccaaagattatgagctacttgttagtcatggaaatgtctgtggtttagtattaaatttcaagacaaacaaaaggcacttccattttggttatgatggataatggattttggaattattctttgcttgtacaaacaacagtggcatgaaaaatgggacaaataaatggaactagtttaggtcttggcaacagagatctcagaatgcatgttgtttttaaatgtcagaaacattcatcacgatagcccttatattggaaaataaaatgttacaataatctttaaaattaaagcaaacatagtgactataataaaattgcattagaagccaattaaatatttctaaaaaatacccaaaatatttagtaataagttggaaaaaagcaataatctgtaatagtattatttataattaaatcaatattaaatactaaataatgcaagataaaataataattacatataatttccaatagtataaaatgactataatatttagataaaatttgtggaattaagctgaagtattgcttggagaaaaatctataacttcaaatgacttgattaaaaaagaagaaaggtttaagattaataattatttgaatatacaagtttacaatactcagctattttcttaagagattcagccaagtttacatatcaaccagtaatagataagatatgctataaatttgtatctttctagcatctgatattgtcagacttttgaaatttcactaaccaactgactgtaaaatatagtagcacatcatggtcttaaactgcatctttctcaacactaatggagctggatataccctcatattctacaaaccatacatatttttatattttatgacaaacttattcaaactgtccatatttccctggggtttgtgtttttcttttaaacttgtataagttctttatatagtctttgttgtgtttattaaatatgctttctctcagcttctagctgatctctgaaataaatatgatgtactgtataaagactagtttggagaaaaactgtgtcataaattttagtgttaacacttattcaatgtgtgacctgtggttattcagcacctcttgacttaagttgtatgttaagtagtcaaaaattcatgctgctagtgataattaggaatcaaataacattgctgagctcttattatatgccaaacactgtgccaggccctcggttagggagaggtgacacattctctgacctcgcccatgagtatggtgtaatgagaagcggatgaacaaacaattattgtgaactgtaatagtgtgac

SEQ ID NO: 464305 - DNA, 932 bp, Homo sapiens
gagaaaaacctgaaaacgctgagaggtggagtgacaacttgcattcagctgtttcagaaacattgttgaccacctactcaatgtgaagatgacgaagatgaaagcctttatgatgatctacttccacttaataaatgtacttatccatgtgcctgaaatatattagttgatcagtaaatgttgcagtaaatgaaggaggaatggaaaggaacaaagaaagaaaaaaatgaatggcatgctatctggagggtacaaggaagatttaagccaaaagcataaccctgcaacaaaaatcaccatgtctagaattcaaccattaaagatttaatttttcacattaagcatttcagtgaaggtgtttttctctggtgggcggcaagttccactggtcccagacaggtccagagatgacatccaggagccagggcctggagtcagaaacttcaggaatctacctggtgttctattctactgtgactgagctggcactcaagccacaaaacaaagcccttcctactcttctctgtcctttccacaaacagaggagtctcttccctaggccccaggccaatggaagtcagaggcgggctgctgaagaccggctctatggtatcgctagtgacccatgctccttccactttctgctccaccattctggatatgtagcttttgtccttggcttcaagatagctcctttatcactaagcattgcttctggatttgaaaaagaaacaagggagaatgaaccaaaatccctcccttttttcctctactcttgtattctcatcaatcactcagttattttgcacatgtctagttctatgtaatttctacatttgtctgtataatgttatctttgtaaggtgacttatctctgtacaccataggcactattttccctactttacaagaggaaattgagtgtcagaaag

SEQ ID NO: 464306 - DNA, 4371 bp, Homo sapiens
cggcaggagtgtatggctcctccaggtgatgtcctgccctgctttggctcgccctccgtgggctgcactcactgtccaaccagtcccaatgagatgaaccagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagtt

SEQ ID NO: 464307 - DNA, 3185 bp, Homo sapiens
cgtagcccacctgtcagatgaccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagttaccaagtcttggccaaattttatcttctgcctatagtttttactagcctttttaaactataatagtgagtgatcattactttatattctcgtaagttagaaatacttgaatgccaaattaattttgttttaagaaagcttatttttaacataattttttagtgtggagggtttgtaaataatgtaaagtttgtaaacctgtatttaaaataccaaagtttttcttcttttataacattgtaagatactagaaaaatgggcttcaagttttttaatagctttcacagtttgtgtagttttttttttctatttggttaagatgtgagttggaaatgtattatttgaaacatttaaactaatttttgtatttaacagcagtctcagacatttgtcttttcaactcagttgagttgtagatatcaaatagaaatgtccagttttgcctcttttaagtactgtccagttgaaacctcctgactcatgtactactacacaaactagaaaatgcccatttatttttatgttgattcaacactccagatacagattgatacatatatactaatcattttatttcatgtaaaagttttacatctagggtgcctatttatttttatagatgctttcatccagttataagcttattataactttgtaaatatttcagccaacagttgtaatgtttaaaatacttaccttcagaatgttatattttcatgtgaaatcaatttcttctaattcaaaaaaattttaagataaactgatttttaagtttatatgattggacttctctttgcattcatgaactgtgtgtcaccctcccaccaacgtggattattttgggacatgttaagtcgcgggtacttggaatttcactgatcataaacggttatcacaggagatcctaggagttaaactccagcaaggtctaaagcacagctccttagaaaaggagttggcaaactttctataaagatagaaaataatttaggctttgtggaccataatatttctgtaataactactcaa

SEQ ID NO: 464308 - DNA, 3071 bp, Homo sapiens
  misc_feature (2316)..(2316): n is a, c, g, or t
  misc_feature (3004)..(3004): n is a, c, g, or t
cggcaggagtgtatggctcctccaggtgatgtcctgccctgctttggctcgccctccgtgggctgcactcactgtccaaccagtcccaatgagatgaaccagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcaggtaatgtaaaagttgagtgaatcatttttccatcactcttcttttttgttaattgcatgaagtaatttttgaagtttggggtcaattaaatagaacagaaacagcatgagctgttttaaagagctttaaaaagtttgtttcttttaaacacaagtatgtttctgtaaagaaacctaggatattgtagtttatttgatattttagatttccattttgaatagttatttcctgattccaaaaatagcagctttttatttttagaaaatttggaaagtacagaagtttattatcattgttgtgtcactgtcaacaattgattggttttaaagcacagacttcaattggtatcatctaagtcattaaggtggttgtttaattcttctttttttggtgggaggggaaggagtctcactctgttgcccaggctggagtgcagtggcgcaattacgggtcactgcaacctccgcctcccaggttcaagcgattctcctgccttaacttcccaagtagctgggactacagacangcaccaccacgcctggctaatttttgtatttttagagacggggtttccccaggctactcttgaactcccaacctcaggtgatccacctgccttggcctcccaaagtgctgggattacaggcctgagccactatgcccaggctgttgtttaattcttcaatctatataatgtttataatcccatctctaacatttgtaactcagaactgaagctagtttttactgtcacactcattctcatggaagagatattttccctttagcaaatataaaaaaaatcagccaaataactttgtgttcgattaattctaaatacatttattatattactgtttaatccttctaacaatgtgtttgtttgatattagctgatatttgaccacatttgttattaaaaggtagatttgcaaaaatcaactgctcatgttttatgaaaatgcttgtttcaataaagacttaaggaaagggccaggtgtagtgtttacacacctgtaatcacagcaccttgggaggctgaggcaggaggattgcttgagcccaggagttcaatactagcctgagcaacatggaaagatctcatcatctctaggaaacagttttaaaatattagccaggtattgtggcatatgcctgtggtcccagctacttgggaggctgaggtgggaggatttttgagcccaggaggtcgnggctgcagtgaaccatgtttgtaccactgcactccatcctgggcaaaagagcaaaaggtcctggctc

SEQ ID NO: 464309 - DNA, 1488 bp, Homo sapiens
tgtcagagcatgaatatggcaggattatccttagaatataacactaaattttctttagagttatccaagatgctgatgggagaagatggcgctcttctcccatcagcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagttaccaagtcttggccaaattttatcttctgcctatagtttttactagcctttttaaactataatagtgagtgatcattactttatattctcgtaagttagaaatacttgaatgccaaattaattttgttttaagaaagcttatttttaacataattttttagtgtggagggtttgtaaataatgtaaagtttgtaaacctgtatttaaaataccaaagtttttcttcttttataacattgtaagatactagaaaaatgggcttcaagttttttaatagctttcacagtttgtgtagttttttttttctatttggttaagatgtgagttggaaatgtattatttgaaacatttaaactaatttttgtatttaacagcagtctcagacatttgtcttttcaactcagttgagttgtagatatcaaatagaaatgtccagttttgcctcttttaagtactgtccagttgaaacctcctgactcatgtactactacacaaactagaaaatgcccatttatttttatgttgattcaacactccagatacagattgatacatatatactaatcattttatttcatgtaaaagttttacatctagggtgcctatttatttttatagatgctttcatccagttataagcttattataactttgtaaatatttcagccaacagttgtaatgtttaaaatacttaccttcagaatgttatattttcatgtgaaatcaatttcttctaattcaaaaaaattttaagataaactgatttttaagtttatatgattggacttctctttgcattcatgaactgtgtgtcaccctcccaccaacgtggattattttgggacatgttaagtcgcgggtacttggaatttcactgatcataaacggttatcacaggagatcctaggagttaaactccagcaaggtctaaagcacagctccttagaaaaggagttggcaaactttctataaagatagaaaataatttaggctttgtggaccataatatttctgtaataactactcaa

SEQ ID NO: 464310 - DNA, 3441 bp, Homo sapiens
cggcaggagtgtatggctcctccaggtgatgtcctgccctgctttggctcgccctccgtgggctgcactcactgtccaaccagtcccaatgagatgaaccagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtcccggggttcataagcgggcttcttggccacacaatgctttgacaaaccttctcttgggggccccaacgggtcccctgtttgggtctaaagcgggagtaccccggttaaactattcgcttgggacaacttc

SEQ ID NO: 464311 - DNA, 652 bp, Homo sapiens
acagaatttgtgcggtacatttctacaacagccttatggtaagaacctattaaagcttaattatcaacgatattaataacatatttaagcacattgagcacttattttataaaatcatagcatacatgaatttcccctctctgtctgaggctaccaagtatgctgctgtgagatgtattaagtgatgtctatcaaagttggatgtttgtaatttggcctaatatatgtgttacttagtgaagtgtacataatactagttaaattttatatctatttaatttataacaaattttagaactgtgaaggggagcatgaaatgataaactgaatgttaaatggaactatacatggttgcttcatttatgagatgttctgtttgtaatggccatattttcagtcagctccactatgtccctttctggtgataaaagctagggtaagcggagaagaaagaaaaatgtgagcgtaattctcaggttattgcatttgaggactcatcattcactttaaataaaaaatttgccatgcttgcctgctcagctgcccactcactctctccctttctgtccatgaaagattagctcgttaaggatctaaaagttatccctagaccttacataatgttctttgaatattttccaacaggtatttg

SEQ ID NO: 464312 - DNA, 451 bp, Homo sapiens
atgtttattttcccctagtttcatatatttgcatagggtgttctagctttgtttttattttcatatttcagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggt

SEQ ID NO: 464313 - DNA, 5399 bp, Homo sapiens
cggcaggagtgtatggctcctccaggtgatgtcctgccctgctttggctcgccctccgtgggctgcactcactgtccaaccagtcccaatgagatgaaccagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagttaccaagtcttggccaaattttatcttctgcctatagtttttactagcctttttaaactataatagtgagtgatcattactttatattctcgtaagttagaaatacttgaatgccaaattaattttgttttaagaaagcttatttttaacataattttttagtgtggagggtttgtaaataatgtaaagtttgtaaacctgtatttaaaataccaaagtttttcttcttttataacattgtaagatactagaaaaatgggcttcaagttttttaatagctttcacagtttgtgtagttttttttttctatttggttaagatgtgagttggaaatgtattatttgaaacatttaaactaatttttgtatttaacagcagtctcagacatttgtcttttcaactcagttgagttgtagatatcaaatagaaatgtccagttttgcctcttttaagtactgtccagttgaaacctcctgactcatgtactactacacaaactagaaaatgcccatttatttttatgttgattcaacactccagatacagattgatacatatatactaatcattttatttcatgtaaaagttttacatctagggtgcctatttatttttatagatgctttcatccagttataagcttattataactttgtaaatatttcagccaacagttgtaatgtttaaaatacttaccttcagaatgttatattttcatgtgaaatcaatttcttctaattcaaaaaaattttaagataaactgatttttaagtttatatgattggacttctctttgcattcatgaactgtgtgtcaccctcccaccaacgtggattattttgggacatgttaagtcgcgggtacttggaatttcactgatcataaacggttatcacaggagatcctaggagttaaactccagcaaggtctaaagcacagctccttagaaaaggagttggcaaactttctataaagatagaaaataatttaggctttgtggaccataatatttctgtaataactactcaa

SEQ ID NO: 464314 - DNA, 3135 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncnttggccggtggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagtt

SEQ ID NO: 464315 - DNA, 3899 bp, Homo sapiens
cggcaggagtgtatggctcctccaggtgatgtcctgccctgctttggctcgccctccgtgggctgcactcactgtccaaccagtcccaatgagatgaaccagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggccaactctattaataagactggtcaaatatttttccctaacttcagtttttacatagccgtgcttttctattggtactgtagaagcacctttctttggacctatttcatag

SEQ ID NO: 464316 - DNA, 1445 bp, Homo sapiens
cggcaggagtgtatggctcctccaggtgatgtcctgccctgctttggctcgccctccgtgggctgcactcactgtccaaccagtcccaatgagatgaaccagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaactacattatggaaatgcaaagttgtttgatatgtacggatcaccgggatcctcta

SEQ ID NO: 464317 - DNA, 1259 bp, Homo sapiens
tacaagacagccaattcaaggttcagagtggtgccctctgagttcaaaagaggaacaggcttccactctcctaacctccacttgatgactttcagtacataatgagcgctgcgctgctgtcaaaggagcagaatctgtgcctagaagaagttaaagtgaaagaagagaaaagcgtccaaaatagcatatcattcctccctgccgaagcaatgatgatttttaaagtagaaattgccgaaatcccccttcaccctgtgaagatgcagcaagaaggaaccacctatgaggaatgtgcccttgccaaacactatgtctgccagcagcttgatcctggacttcccagcctctggaacaaagaaatgagcaaagaaactgatgaagacgtttataaatttaaacaagcactgactggcactcgtactacttatactgccactaacactattaataatactaataataaccaattgggaagaggaatacatcatatcatgttgaatgaaaaaatgttgaagtaatgtaaagtaatgttgaataaggaaagcaagatgcagaagaatacgcctggtattataccatgcctttttattttaaaatacaaaaactatacaaaatattgctttgaatgtgtacatacatgatacaattatttttaatggttgggaaggtaatttatcctgtgcattaacaagaggaagtctagagccatggaaaccaagtcaggaaacttctctcttattattaggtccactgcaaatctagttgagactgcaaatcgagagctctgttcactggctttcgtctcctttcctcaacacagtttagtcaccacctccgaggaactgtgtcccgcattggcattcctttggcagcttccacttctctgtccccttgagcaaagtttttctcaggggaagccgagctccagactattcatttgtcctgaggcagccacttgaaacacaatcattttgtatttctacgatgttttgaccttttatccaagtcagccctatagaatgggccaggaggttgctgccactgaataagccactgtgatttttagcgtcaagaattttgctgttaactatggcagaaaaatagacagaggacaataaaaataactaacatagactaattgcaaagaatcttaatatgttcttacagtcatcattcttttattacagttcctgacttcctcatataatgataattgaaaatccccttgaacttggagtctttgcttagttcctgaatcc

SEQ ID NO: 464318 - DNA, 595 bp, Homo sapiens
ccagcccaccctgcagagtgcatttgccagcctccacaatcaggtaatttatcctgtgcattaacaagaggaagtctagagccatggaaaccaagtcaggaaacttctctcttattattaggtccactgcaaatctagttgagactgcaaatcgagtttagtcaccacctccgaggaactgtgtcccgcattggcattcctttggcagcttccacttctctgtccccttgagcaaagtttttctcaggggaagccgagctccagactattcatttgtcctgaggcagccacttgaaacacaatcattttgtatttctacgatgttttgaccttttatccaagtcagccctatagaatgggccaggaggttgctgccactgaataagccactgtgatttttagcgtcaagaattttgctgttaactatggcagaaaaatagacagaggacaataaaaataactaacatagactaattgcaaagaatcttaatatgttcttacagtcatcattcttttattacagttcctgacttcctcatataatgataattgaaaatccccttgaacttggagtctttgcttagttcctgaatcc

SEQ ID NO: 464319 - DNA, 1139 bp, Homo sapiens
tacaagacagccaattcaaggttcagagtggtgccctctgagttcaaaagaggaacaggcttccactctcctaacctccacttgatgactttcagtacataatgagcgctgcgctgctgtcaaaggagcagaatctgtgcctagaagaagttaaagtgaaagaagagaaaagcgtccaaaatagcatatcattcctccctgccgaagcaatgatgatttttaaagtagaaattgccgaaatcccccttcaccctgtgaagatgcagcaagaaggaaccacctatgaggaatgtgcccttgccaaacactatgtctgccagcagcttgatcctggacttcccagcctctggaacaaagaaatgagcaaagaaactgatgaagacgtttataaatttaaacaagcactgactggcactcgtactacttatactgccactaacactattaataatactaataataaccaattgggaagaggaatacatcatatcatgttgaatgaaaaaatgttgaagtaatgtaaagtaatgttgaataaggaaagcaagatgcagaagaatacgcctggtattataccatgcctttttattttaaaatacaaaaactatacaaaatattgctttgaatgtgtacatacatgatacaattatttttaatggttgggaaggtaatttatcctgtgcattaacaagaggaagtctagagccatggaaaccaagtcaggaaacttctctcttattattaggtccactgcaaatctagttgagactgcaaatcgaggtttttctcaggggaagccgagctccagactattcatttgtcctgaggcagccacttgaaacacaatcattttgtatttctacgatgttttgaccttttatccaagtcagccctatagaatgggccaggaggttgctgccactgaataagccactgtgatttttagcgtcaagaattttgctgttaactatggcagaaaaatagacagaggacaataaaaataactaacatagactaattgcaaagaatcttaatatgttcttacagtcatcattcttttattacagttcctgacttcctcatataatgataattgaaaatccccttgaacttggagtctttgcttagttcctgaatcc

SEQ ID NO: 464320 - DNA, 419 bp, Homo sapiens
cacacttacaatttatatagtatataaaatctggattaaagtcaaaatgcattgaaattgtttgggattactctaatttgaaacttaggttttttaagactttaagcagaagctgttttttaacatttcaaaaatatatgtataatacatattttctataaaaaataaaaataaaaattgcaggtaagaaaaaaaaataccccagtcttcctgtttgagattctgtcaattggctgttttcctcccattccctagagctctgttcactggctttcgtctcctttcctcaacacagtttagtcaccacctccgaggaactgtgtcccgcattggcattcctttggcagcttccacttctctgtccccttgagcaaagtacgtaccagacatagcccagccttaaactagaacacttgaaa

SEQ ID NO: 464321 - DNA, 2097 bp, Homo sapiens
aacgagtggagacacgaggaccagcgcgagcggtcccggtgggctaccctccccctgcgacgaccccccctcgctctgaccgactggtcccctaaacggtggcggcggtttttggtcgttgggccccgggatttaggaccaacatttgaagacccgaaggggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggtgtgtgtgtaagcctggataattgtagattatttattggagctattcccaaggaaaagaagaaagaagaaattttagatgaaatgaagaaagttacagaaggagttgtagatgtcattgtttatccaagtgcaactgataagaccaaaaatcgtggttttgcatttgtggaatatgaatctcacagagctgctgctatggcaaggaggaaactaattccaggaacattccaactatggggccacaccattcaggtagattgggctgacccagagaaagaggtggatgaggaaaccatgcagagagttaaagttctttatgtaagaaatttaatgatctcaactacagaggaaacaattaaagcagaattcaataaatttaagcctggtgcagttgaacgggtaaagaaacttagagattatgcttttgttcactttttcaaccgagaagatgcagtggctgccatgtctgttatgaatggaaaatgcattgatggagcaagtattgaggtaacactagctaaaccagtaaataaagaaaacacttggagacagcatcttaatggtcagattagtccaaattctgaaaatctgattgtgtttgctaacaaagaagagagccacccaaaaactctaggcaagctgccaactcttcctgctcgtctcaatggtcagcatagcccaagtccgcctgaagttgaaagatgcacttaccctttttatcctggaacaaagcttactccaattagtatgtattctttaaaatccaatcattttaattctgcagtaatgcatttggattattactgcaacaaaaataactgggcaccaccagaatattatttatattcaacaacaagtcaagatgggaaagtactcttggtgtataagatagttattcctgctattgcaaatggatcccagagttacttcatgccagacaaactctgtactacgttagaagatgcaaaggaactggcagcccagtttacattacttcatttgggtcctatttcggtggagtacgcaaagcctgaggtcttgtctatggacagtaacacagaaatccttatggtgcttgactacctatgtactgactatgggatacccatcatgaattgggtgttatttgatcacgaaattcataaagttgagcatgttcaacagcactgctacaaagtggaatatggtgacagtctagaagcttcttcctgccatactaccatcacttggcctgttatatcatggaacgcacccaagatcagttggctgagggagaaatctttggaacctagtatcctaaggataatggaagtcaccaaaaacaaatctctttacacatcctatacaaactatatagaaaaataataaaaagcaaatgaaaccacacatgatccacaccttcagcataaccacagaacactacaacttttcaaattacctgttaataaaaataaatatatatggacatcaagttccagcaattatgtttttagctcttgccacaagcctttggagaagaaggggtg

SEQ ID NO: 464322 - DNA, 876 bp, Homo sapiens
gatggagtggagagctttcctcctcatcacctgggtcaggaccatggagctccttgagccttgagattccaggcccaggagcacatcatcattgtgcttcttggggcccaggcgcatctcctaagaacttgttcttagacatgttgtgctcaaacttgtggcatcatagcagtaatagtttacaatatacctacagtttcctgggcagatcatcgtgtgcagaccggctgcagagagaagggaactgtttcactttcatcttcctgggccatttccagatatgaattgcagagacatatttcaatatatcctcacccaaatatgctttagaagtacatttcttttaatgtaataagatttatgtcctttgtgtttgtttagagggtaaatctggatttgtatttttagaagttactttcaccaaagaaattcgaaagaaatagtgtttcagaaaaatcaaaacaagccatagaaatctaatatgtttcagatactatattgggctgcatgaagactaaatccataatatgtatgaataatgtattctaaagtaaatatcatattttgtcaaattatttgtctggcaaaattaagttcttttttctttaaaatgaactttttttcttatttcgaagtgatgtgtatgtaaagaggcagtgtagactggtggttaggagcactctggagtcagaagcctgcttcagaatcttggctacctcacttaccaaggatagagctgtggggagtttacttgttctcactctctcttcttttttccatctgtaaaatggcaaaaataaaccacctaagtaaaatggcctctgcgagagagaaataaattaatatatgttgctatggtttaaatgtgtctcctct

SEQ ID NO: 464323 - DNA, 1036 bp, Homo sapiens
gttctcaaagatgagaactggatggagaggcgctattccgctaaggtggaggaacagggctcggaacagagagaaaccacacagcccaagggcagtgtcatctcctgccacgcacagccttcctccatccaatccatgcagactgacgcctaccctgagctcagccagaccccgggagggaagctgcccttcaaagtgctcatgtccagggtctcattctgtctcccaggctggagtgcaatggcacaatcatggctcactgcagcttcaacctcctgggctcaagcaatcctcccacctcagcctccagagcaactgggactacagagcagtaatagtttacaatatacctacagtttcctgggcagatcatcgtgtgcagaccggctgcagagagaagggaactgtttcactttcatcttcctgggccatttccagatatgaattgcagagacatatttcaatatatcctcacccaaatatgctttagaagtacatttcttttaatgtaataagatttatgtcctttgtgtttgtttagagggtaaatctggatttgtatttttagaagttactttcaccaaagaaattcgaaagaaatagtgtttcagaaaaatcaaaacaagccatagaaatctaatatgtttcagatactatattgggctgcatgaagactaaatccataatatgtatgaataatgtattctaaagtaaatatcatattttgtcaaattatttgtctggcaaaattaagttcttttttctttaaaatgaactttttttcttatttcgaagtgatgtgtatgtaaagaggcagtgtagactggtggttaggagcactctggagtcagaagcctgcttcagaatcttggctacctcacttaccaaggatagagctgtggggagtttacttgttctcactctctcttcttttttccatctgtaaaatggcaaaaataaaccacctaagtaaaatggcctctgcgagagagaaataaattaatatatgttgctatggtttaaatgtgtctcctct

SEQ ID NO: 464324 - DNA, 467 bp, Homo sapiens
ccgaaatttttaaaggagacttgacagcagctgagcctagctgccactgatgctcaagggagctgcgtagtaagggagagcctcccaggagtagtaagggagagcctcccaggagaagaaggaagcacagtctgagctgtgccttttgccttttttgtttgtttctgtaccacagaaactgctgctgcacaggctgtttgccgcacaggcttggtgctgagctgtgaaaagcatgttctgggatcttgtcacttcgcggaggtggcctgtgcagcatgaggcaaagacctggcctgtttagtcaggaagaactgggttggagcctggtgtcctctttaacagctatgtaaccttgggcaaaatacccattcaaatttcagtgttctcctctataaaacagaaatacgtgcgtgtatcagaattattaaaataattaaattttctaatttttaagtgcccagtttata

SEQ ID NO: 464325 - DNA, 2005 bp, Homo sapiens
tttttctgccgtggttcgttcacaaggcgcgactgtaggcagaggctccctgttctgaagctggctgtcagcactcccccaactgccgtctcaagcagagaaagcaagggagggaagcttccaggaccaagccctggtgggcaggtagcagcccacctccagtgagacggagaagttggccggggccagcaatgaaggaccagcctgtctcctccccgagaactgaaaggcaaaaggcacccaaggctgggaagagagcagcagcctcaccaagtaaggaagacaaaatgaagcaatcagtgagggtttcctgggtctacacagggattgaaggagacacttctgggtgatgcgagtgctgcgcagctcagaacccttggaagcatgagaggaggacgagcccggcggcctgccggtgcggtgatggagggctcttcggtagccacactgcgcgcctcccacacacaccttaacagtcttggggccccgggccagcgctgcagcccaaagagaccctgcagccgcattttctcccaggccgtggcaaaccctggcttcgcctcccttcaccatggcttgtgagggcaggaggctcccgggggccgacttccctgacctgaatgagtcaggcacccttctttattttaagtgggggtgtgacctgaggagataaaggaaggacgacagacctggggagtggggccctgcagcctcttgggcccggagcgcactccttctcgctccctcccctcaccggcaggatcgggggtcttgaaactggagccgctcaccggccggcggatgagagataaaggagcccggcgacgcgaatgcgtttgaccagcagacccggatccggactttcccgcgctccagagcagcacccgaaaccctacttcccaggtggcacgacggctgagcagctcctccggtgccatacggtgtctccaggcacagacagtcgtgctcgcgtgtgtactgtgcacgcacaagactgcaggatgatgtcctgtatgagccctgtattagcccctttgctctcagccagaggcttcctgggagacccactgcgccgggtgtggggtctcaattcctgtgctgataagcactatcttctggagctgggtgaccctagtgcccagggcgggaagtcgggagctggccggagtgccgctgaggcgatcccggcggttccaaggccatggctgaccacgcgcaactgggttgcaaagcctggcgggcctcggtctctaaagcagccacgccaggcaaaccttgaccacatcccgggggtgcccttgggcctctgcgccgggctcctgcagactgaggtcgctggtctctgggctccaaggccgcctctaccccgcagaatccgggagctggaagggagcccgcggtttggcgaggtcgccgttcgggctcacggcctcgaggctgccctctgctggcactgggcgacattaccaccgcctccctcggcggctcaggagctgcacccacgtgagggagtggctgccgcacctgcagccactgacgagaccctcccgtatttctcaatccgagacttctccccgcagacaccagaggctccggtgctcggacccagggacaaggcagagagccggagctctgcgctggcaatcccgccgctttggcccgccgggatccgcggccaaccagggcacggccacaggcggacgctgggggactccggggatggccccaggctgtgttcgtcccctttactctccgccaccatagcattgattggcgcccacggaagagggccttctagcccctgctgccagccatctccctctgctggagaccagtgtagctggggtggtgagagggacatcttgaaagatggcaggaaccagcaatgtgtctgaagagctgtcctagcctgcttctaggaccaaagccctgtatccccaactggcacacaagatgatgtttgtgacctgggctactgtgtacagtgtcttgtaatggttaggag

SEQ ID NO: 464326 - DNA, 565 bp, Homo sapiens
tttttctgccgtggttcgttcacaaggcgcgactgtaggcagaggctccctgttctgaagctggctgtcagcactcccccaactgccgtctcaagcagagaaagcaagggagggaagcttccaggaccaagccctggtgggcaggtagcagcccacctccagtgagacggagaagttggccggggccagcaatgaaggaccagcctgtctcctccccgagaactgaaaggcaaaaggcacccaaggctgggaagagagcagcagcctcaccaaaaactgctgctgcacaggctgtttgccgcacaggcttggtgctgagctgtgaaaagcatgttctgggatcttgtcacttcgcggaggtggcctgtgcagcatgaggcaaagacctggcctgtttagtcaggaagaactgggttggagcctggtgtcctctttaacagctatgtaaccttgggcaaaatacccattcaaatttcagtgttctcctctataaaacagaaatacgtgcgtgtatcagaattattaaaataattaaattttctaatttttaagtgcccagtttata

SEQ ID NO: 464327 - DNA, 1992 bp, Homo sapiens
atggacagagcctttgcttcatcaggcagaggctccctgttctgaagctggctgtcagcactcccccaactgccgtctcaagcagagaaagcaagggagggaagcttccaggaccaagccctggtgggcaggtagcagcccacctccagtgagacggagaagttggccggggccagcaatgaaggaccagcctgtctcctccccgagaactgaaaggcaaaaggcacccaaggctgggaagagagcagcagcctcaccaagtaaggaagacaaaatgaagcaatcagtgagggtttcctgggtctacacagggattgaaggagacacttctgggtgatgcgagtgctgcgcagctcagaacccttggaagcatgagaggaggacgagcccggcggcctgccggtgcggtgatggagggctcttcggtagccacactgcgcgcctcccacacacaccttaacagtcttggggccccgggccagcgctgcagcccaaagagaccctgcagccgcattttctcccaggccgtggcaaaccctggcttcgcctcccttcaccatggcttgtgagggcaggaggctcccgggggccgacttccctgacctgaatgagtcaggcacccttctttattttaagtgggggtgtgacctgaggagataaaggaaggacgacagacctggggagtggggccctgcagcctcttgggcccggagcgcactccttctcgctccctcccctcaccggcaggatcgggggtcttgaaactggagccgctcaccggccggcggatgagagataaaggagcccggcgacgcgaatgcgtttgaccagcagacccggatccggactttcccgcgctccagagcagcacccgaaaccctacttcccaggtggcacgacggctgagcagctcctccggtgccatacggtgtctccaggcacagacagtcgtgctcgcgtgtgtactgtgcacgcacaagactgcaggatgatgtcctgtatgagccctgtattagcccctttgctctcagccagaggcttcctgggagacccactgcgccgggtgtggggtctcaattcctgtgctgataagcactatcttctggagctgggtgaccctagtgcccagggcgggaagtcgggagctggccggagtgccgctgaggcgatcccggcggttccaaggccatggctgaccacgcgcaactgggttgcaaagcctggcgggcctcggtctctaaagcagccacgccaggcaaaccttgaccacatcccgggggtgcccttgggcctctgcgccgggctcctgcagactgaggtcgctggtctctgggctccaaggccgcctctaccccgcagaatccgggagctggaagggagcccgcggtttggcgaggtcgccgttcgggctcacggcctcgaggctgccctctgctggcactgggcgacattaccaccgcctccctcggcggctcaggagctgcacccacgtgagggagtggctgccgcacctgcagccactgacgagaccctcccgtatttctcaatccgagacttctccccgcagacaccagaggctccggtgctcggacccagggacaaggcagagagccggagctctgcgctggcaatcccgccgctttggcccgccgggatccgcggccaaccagggcacggccacaggcggacgctgggggactccggggatggccccaggctgtgttcgtcccctttactctccgccaccatagcattgattggcgcccacggaagagggccttctagcccctgctgccagccatctccctctgctggagaccagtgtagctggggtggtgagagggacatcttgaaagatggcaggaaccagcaatgtgtctgaagagctgtcctagcctgcttctaggaccaaagccctgtatccccaactggcacacaagatgatgtttgtgacctgggctactgtgtacagtgtcttgtaatggttaggag

SEQ ID NO: 464328 - DNA, 3377 bp, Homo sapiens
gctttataacaatggtgagagcgtttccagttttcccacgttttcctgcatgaggcttgggcagaccctcccttctctgagaatctgggggatggaattcaccaaaaccacctgtcgctcccaagccaaagactaccagtccactgacgccagtgaccgcgcccaaattcccttcctcagccaggcccgagagtcttcacagctgactgccccaaacgagtggagagccagtgtgtacctgaatgacagcttgaacaaatgcagcaacgggcggctgccctgtgtagacagggggcttgatgaggggccccggtccatcccaaagtgctctgagtcggagaccgacgaggattacatcgtggtccccagggttccgctgagggaggatgaacccaaggacgagggcagtgtggggaacaaagccctggtgtctcccgagtcctctgcggaagaggaagaggagcgtgaagagggaggcgaggcatgtggcctggagggtacaggagctgtgcagccacacagggagtgcagcctggaggacagtgggccttgggctggagagggggtcttccagagcgacctcctcctgcctcacatccatggagaggaccaggagccccccgacacccccggggaggcagaggaggatgatgaggaaggctgtgccagcacagacccagcaggggcagatgagggttcgggtcctgacaggcccacggaggacatgggacaggatgctgaggacaccagtgaggagccccctgagaaggaggagctggccggggtccaggaggcagagacagccacagactgccctgaagttcttgaggagggatgtgaagaggccacgggtgtcacaggtggggaacaggttgacctcagtgaaccacctgaccacgagaagaaaaccaaccaagaagtggcagccgccaccctggaggaccatgcacaggatgagtccgccgaggagagctgccagattgtcccttttgagaatgactgcatggaggacttcgtgacttccctcacaggaagcccctatgagttcttcccaactgagagcacctctttttgcagcgagagctgttctcctctttctgaatcagcgaaaggtttagaatcagagcaggcaccaaagctggggctgcgtgcggaggagaaccccatggtgggggctttgtgtggccagtgtggctccctacagggtggagcggccgagggtcccgcagcccctgatgtggtggtcgtgctggaggaggaggccttggatgatgcactggccaacccctatgtgatgggagtgggcctgcccggtcaggcggcccctggagaaggagggcaggctgcatcggacgccctgggtggttatggctcgaaagaagaattgaactgtgaggcagagggtggcctggttcccgcggacaggaagaacaccagcacgagggtccggccccactctgggaaggtggccggctatgtcccagaaaccgtccctgaagaaaccggacctgaggcgggctcgtcagcccctggcattggaggtgccgcagaggaggtgggaaagacgcttttgtcattggaggggaagcccttggaagccagcagggccttgccagcaaagcccagggcctttactttataccctcggtcgttctccgtggaaggccgagagattccagtgtccgtgtaccaggagcctgaggggtcagggttggatgaccacaggataaagaggaaagaggacaatctctctctgtcgtgtgtaattggctcctctgggagtttctcccagagaaaccaccttccgtccagcggcacctccacgccttcttccatggtcgacatcccacctcctttcgacctggcctgcatcaccaagaagcccatcacaaagagctctccctcactcctgatcgagagcgactccccggacaagtacaagaagaagaagtcatcctttaagcgcttcctggcactgacgtttaagaagaagacggagaacaaattgcatgtggatgtgaacgtgtcttcctctaggtcctcttcagagtccagctaccacgggccttccaggattctggaagttgaccggagaagcctcagcaactcccctcagcttaagtctcggactgggaagctccgggcttctgaatccccctcctccctcatcttttatagagatggcaagaggaaaggtgtccccttcagcaggacggtgtccagagtggagtcctttgaagaccgctcccggccgcccttcctgcccttgccactgaccaagccacggtccatctccttccccagcgctgacacttcagactatgagaacattccagccatgaactcggactatgagaatatccagattccaccccggagacctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaaggtacctgacattctatttcctttcttgttcggcagctgtaactgtccaggaggcagcgtgggtgtgggggacagatggacttgctttccagcctcaggctctgtttcttactagctgtgttgacttgggcgcctacacagagccctacaaagtctgtcccatctcgtcggcagcccccaaagaggaccttacgtcggatgaagagcagagaagctcggaggaggaggacagtgcttcaagagaccccagtgtcacccacaaggtagggcaccccacagtttcctcatctgtgaagtggaaatcatgagggtgagatgtgttaaaggctatcagggaattttgtgaactgaaaagttttagatgaaagctggtttccctggccctgcagcagtgctgtgaggggatggagttgctggagggaggttgctgtctagaggctgatgtcccttctctctccagtggctccttcacaccctccccacccccttcccctctcactcatctccccgctgcctcttcctctctaggtactgagccacgtatctggcactgtcctgaggttgtccatgtttgtcatctccttgactccttacaacaacttcaaagttggcaccattactcctgttttacagttgaggacacagaggttctgagaggttaagtaacttgcccaaggccacacagctagtgaatgaaggggtcaggtctcaagcacagctctggctggctccaagtccagtgttgcctatcactgcgggccttctctgacctctccactcctcctctcccaagaaggagtattgtctccttgtggagaagggaggagagccttgagttagtcgtgcccattt

SEQ ID NO: 464329 - DNA, 917 bp, Homo sapiens
gcctccttgctacttatgcaaactcctacagccagcttaaatttctcctcagaaaatgggtttttattttctactgcatcatcaggctgcaaattttctgaagttttatgccctatccattctgaactcttggaatcacactggaattcccataaaaagaatgttatgagtgaatggagggactcttcatttgacaccagaaaccaaatcattggtgaatatcgacagatatactgcaggatctatgtttctttagcatgtcctgcaaataggaccaagaaaatatacaatcatccagtaaatattgcacccttgtctacatacaaccagtacgctactgtgatttatattttctttcccatgaggaaagaagtgggagaggtggtagtgaaggaagagagcaaagaaagaagtcagagaggttcacattcagtgaagattgtttcaagtaaagctgtctgatatagagacatggttgctagggagacagagtcataatggctgatgttaccagggaaggatgaatgaatgagtttatgctcaccgatctctcaatctgtggtgaatattcttttggaaaaaccaacatggtgcaaatcttttggtttataaaactagatgtcttcatctgcagtaccctagaactctttagtgacgttccaaggccagagccaaagagcatctgcagcttagtctgagataagggagttttcagattacggcatctgaccaaagtacatgggatcaaccactgtcctttaagaaaaggttgccactgttttgcttcatatgtgaagaaggcatgagtcaagctgaagaataaattggcaccccattagattgagaagccacatcttgtagcccagaatatcttttagaaagcaaaactggattaaaaaagagaaagaaatgttctt

SEQ ID NO: 464330 - DNA, 3072 bp, Homo sapiens
gagagcaagcgagggctctgaggactgccagcatgctgtcacctctcacccccagccaccaactgaatacattgagggactgtagtccctgccacatggagcaggagaattcctctgccaattaccaacctctgtctgaattcctgacctgcaaaatctttgagcaggcctcactgacctccctgtcaggtaatcacctgtctctgtgtctggtttgtgactgcctgaggattccttgcacctggtgctccctccacataaggtccggctccatcctgatacagacgttcctaagatatattcctttagcggaagactcttgcatccatagaaatgcagctgcctcttccacggatgacaccttcacaaattctttcccaccacattgtgtgctgctgactagtgtgctgcaaagaagagaggttaagaacaccagcttcatggtcagccagaaccagttcataatcccaattctgcttacttatttttgactgtttaatacggagcccactgcttcacctctttaggtcttagtttcctggccttaaatggaggcaaaattatgcttgtttcatagggttgttggaaagattaaacaagataccataggcaaaggtctcagcacaatgtctattcttgagcaaatgcttaataaatgacactgattgttcttagaaaatatattaactaggtctttaatatcctaacatatttggttgtttttaaagcggtgtcttaaaagctaaaataagctgcctactcatttcgagtacatggtgatctacaagttcagaactattttcacaataacacttagagatgccattgcctgtttcggtgcattgacatttgtgtggatggtgtgaaagcattgatgggtaaagctttgttctgtctggctatgaaaccagtattgcaatgacaccaaaatgcactagtagtcattgttatcctttacaccagtcactgaaaaaaaagaaaaagaaaaagaaaaagaaagcaaattttgctgaagaatgtctttgataaactagtaaggttagtgtttgattaagtctttatccttgaatccttttgacattctgtgtgataaaatgataagttcaaataaaatacttttgctgcatactgtggtatcatagttgttgcaaggacaagcactcgtgtgattgagttgcaagctgaactagccaattcttttcatggaatattatttttcctgaaataacaataaacatacacaagctgtgggtattcagacttggatatttggaggatattttcttgaaaatgaaaggagtgagtttatcactccaaagcagacaactgaaagtgtttgttgcaaatgattaaatttgagttttcaagtgaaaattggagctttgggaaacttgacagcttcccactatttaagagttgatattaatgaatatgggttttcccatattcattatttcccaatgtatgatgtgaccaaatcaagccagagccaaggcattttatttgaagtttaaggtcatgtgcagtttgtttcctgttgctggcatccaaattgatataaatcattgactaaaggcaagttagaggaaatgatatagagatacattcaagacagcatgtatacatgactaatatggatggccgattgaggggatcttctaggattagattacacatgattttgctttatttgatgactttagatcctaaccttttgagttagacgtgactctcttgaaaatgtaatgaccacctacagccactgttattctgtaaaagtcaccttgatccccatgccccaaatggtaaggacataatgtacagcatagttctttaaattaaaataaacttatatgtttaaaaaatatattgcatttgtcatatttttgccatcatattgcaacactgacaagtgttgtgggcattgtcttcctggtgctcatcctcttcgtgtgggaagtttactatcattttgtacccaacaatctattctaaacattttgatattaaaaaaatcaagaaccttatttttaatgtctgcccatttggcggtctacctttgggtataatatcatttgctaaacggttcctataatgttggacatttggtttgtatctgtttttcaaaaaatgattatgcataacacttcaaagaacatattgtccttaaatctcagtctgccttttgggttaaatatttaggaaagacactcgatcataacaccggctcacatctctcaggccctcccgtgggccagcccctgtctgtgctgagagctgtgcctgtgcttgcccaggtgttcctagcagttgtcttaacagaactcataccatgatccccattttttcagatgagaacaccaaggaaggctctttcctactctctgtatctgtgcaccttcctgtcctgtgaccagaggacagggaagcaggaaacacaacagtgtttacctgggctctcttccacctgggggcttccctcacaccaccctctgttctggcccagaactcttccctgacttcctccatcttagcactgatggcccacctatcagaccacttactcacaggagaagaaagactgtccatttctgagtccaggctgtcagttaccaagttattgtactgtcagttagcctgcacaccagtgtggaacatcgggcttctttcagcagatccagagctttctgcctgcaaagcccccatagggctggtggctaccactgtgcatgaagaagctcagctcatcacccacctacgtagaatgaaaggacatctgttatgcagagtggcagtatggagagtcccctctgggcctgctcagtgaacacccccctaataaatttgttgctggattcagacctcaagcacatcacagccacattcttcctgctgcctctgctcccagaatctgtggaagggccagggtctctgctgggttcttcccatctgtgatgctcactgatgtccacttgtcctgccttcttccctctctatagagtcaggcagtctgggttctggctcccttgccccgctcctcagaggggtcctgtcccttttatctccagtgct

SEQ ID NO: 464331 - DNA, 1680 bp, Homo sapiens
agtgcctgaggcagctctggctcggagagccttttgctagccccacggggacctctgtgcacggatggacccgcccggacctggcgggaagcggcctggcaggcggcggccccggcggcatcagcagagacaggacggggccgacgccgcgggcccctgaggcgtgcgtgcccaccgggcccggcggcggcaccatgatgccgggcgagacccattcggcggcgcccgggacggcggcggacctgtcgcgatgtcagggctgcgcctctctgcagcagaatttgaatgaatatgttgaagcattaattaccttgaaacaaaaaattatcaatacagataatttgttaacagaatatcagaagaaatgtgatgatatccttttactggctttttctgttgagttttggaactaacttatgtttaattcctgaaagagatgtgagaattgttcctcataggccttctggaagatagtacttaacaggcttcagtagggagcatgtctcacaagcacagtaaacagacagtccttttattcttaatccatgtttaatgatgagttttaaaaatgagattacttttcttgttgattgtgattttcttaacgtctcataagctttttagtgggtgggtttctcttaatttgtactgaggatgtggcatgttttttaggtttacgaataatgtgaaactgaatgtgatacttgctgaatgttatttttgaatctgcaagaagtacagtatgggaaattcaaaatgttgggcaattgactttcattaattatttttgtgatttacagggaaatgtgtgtgtatatatatatctccaaaatcatagaaatagcgttgctgtatattcatgaacgctgtgggcagtcagaagacaattcttggccttacagtcaccacttttctttaaagttgtatcaggatactcatcaggaatatgctcgtgtaaaggaagaatgcttgaagagtgatgctcagaagaagaaactagaagctaaggtgaagaagctgcaagaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggtggtagtactgaatttgttgatcatgatcatttttttgatgaagatcttcaagctgcaattgacttcttcaaacttccccctcctcttctgtcaccagtgccctcgccccctccgatgtcatcacctcacccgggttccttaccgtcttcatttgcacctgacctgccagcacttgagtgcagtggaagtcatgcagctctgatgtcatccagtaagagtatggaagaggagaagatggagtcccagtcaggaccctggggaaccgtccctatgagcaagttgatgtcagcagctgttcatcttcaccagtccactgttctctaacagaatagagacaaggtggttgatgctgtcagtgcacgccaagtgggccacatgctctaggcagttaactcaagaggagac

SEQ ID NO: 464332 - DNA, 2350 bp, Homo sapiens
gggctccctcctccccctcccaccccagtaatttcaatccaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaagcagtggcttggggtttttttttttttttttatcttgttgatcaagtgacacccaggacatgtaaatatttcataagccttaaacatttcctgaggtaagaaacaagctctcaaagcaaaagctcaattagaaatggcccttgtggggaaccttcccattctggtcgaccagaactctagccagatgaaatggcaatgctagcgccaccagcaacgtcagaaacgtagaccttaaagcggttttaaaaatagaaaagaagcgttcctcacatctgccagtaatggaattttctgtcagtaaatggaatgtgtaggcaggacctggaataactggagagagtgcaacgcttcggggtgaagggcgggtggggactggaaatgttgagacgggggcagccatgggaag

SEQ ID NO: 464333 - DNA, 2182 bp, Homo sapiens
ccaacagaatgatgtagcgaggcgtcccggtttatttcatacggggcgggcgttagtcttattactcgtggcgtcggcgccataatcaataacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaagcagtggcttggggtttttttttttttttttatcttgttgatcaagtgacacccaggacatgtaaatatttcataagccttaaacatttcctgaggtaagaaacaagctctcaaagcaaaagctcaattagaaatggcccttgtggggaaccttcccattctggtcgaccagaactctagccagatgaaatggcaatgctagcgccaccagcaacgtcagaaacgtagaccttaaagcggttttaaaaatagaaaagaagcgttcctcacatctgccagtaatggaattttctgtcagtaaatggaatgtgtaggcaggacctggaataactggagagagtgcaacgcttcggggtgaagggcgggtggggactggaaatgttgagacgggggcagccatgggaag

SEQ ID NO: 464334 - DNA, 2406 bp, Homo sapiens
gagctggagcgttttcggggctgtaaagggagaatggcgcatgcggcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaagcagtggcttggggtttttttttttttttttatcttgttgatcaagtgacacccaggacatgtaaatatttcataagccttaaacatttcctgaggtaagaaacaagctctcaaagcaaaagctcaattagaaatggcccttgtggggaaccttcccattctggtcgaccagaactctagccagatgaaatggcaatgctagcgccaccagcaacgtcagaaacgtagaccttaaagcggttttaaaaatagaaaagaagcgttcctcacatctgccagtaatggaattttctgtcagtaaatggaatgtgtaggcaggacctggaataactggagagagtgcaacgcttcggggtgaagggcgggtggggactggaaatgttgagacgggggcagccatgggaag

SEQ ID NO: 464335 - DNA, 773 bp, Homo sapiens
aaagttctacacttcggactctcaatgctcttccagaacccactctttatgactgtactcagcattagtgatggcacaaaagagaagctttgtgttctactgctcagcgcacattcggccaggttcctcttgcagggccttcagccttcctcttgctttgatcgggatgatgccaccaagtggaaggagttgttggatacacattttctaaacaggttcttccccgtaatccctgctaggaagatgatgggtacagtgttgagaagaagcaatcatggtaacagcagcttaaacgaagtggaagtttctctttcttacatttcaagaggagtggaatccgtcagtttggggctgatatggtgccatatgttgttagacactcattccttttccaccctggcatcccttgtttcatggcatcctgcacatcagcagcaacaagaagaaagaagaatacaagaagaaagaacaagatcatgggccaggaaatacttcagtaaaggcatgattacatgattcccaagaagttcagaagaaactgctgtgtgatttgcttgctatgttcctgctctggggacacaagacattgtttttgaaaggtgacaattctctaatcatggtacacagagataaatactttattttcctccagggagaaaaagagatgcagtaaatgcttaatgggtttttcttcaatgccacaaagtcagtagctataaatcttgaacacaagttgaattgtttttgactttttatttccttaggatgttttg

SEQ ID NO: 464336 - DNA, 1920 bp, Homo sapiens
agaatggtgaaaatgtatccttgtaacttgtgaatgtatggctgcttttcccaacatggctcaagggtctcgagtatcctcagggccattgcacgtaatgcttattgcttttatgaataattttggcaaagacgactgttcatgtatgagcaccatgcttcgagctgcattctattaatgagtggcttgaggactcaggaggaacccaaagagaagccagagatgtggcttccaatgccagcagcattgtttatttagctctggtgccaaagaaaaggctgggttctgacgcaacgccatgacaaaggttgaggaggtcgaatccagacaggaaatccttcaactcctaagcggaactctgccccttccagcccggggcctggaagcctgccagcatctcaccagtcctggatactctcaggaacaggcagatcttttccttgaagaaatcattccctagctagagtgccaggtggaattaacctgcatttctgggtcatccttaatggttaatgattaaaaagatgaagggagccttgggaagcaattgactttaggcatctgtatgtgccaaggaattaaaatccataacataatagccagagctggaaaggctccccaaggcccatgacactccttccacctcatggcccctttctgttttccagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacaagggagtccgggtagagaaggaaaaggcattttcatgcgctgggtagctgcatccctgggaactctgcccggaatccttttctctcaaagactcctgtactttcctttttcaccaatgtcctttagcgaggaggtgattgctgctagatgccctgctgtcctgccttccacaggttccccagctccacctgctggaccagagaggcagaggatcaaaatgcaagggccagggttggaggagatatggtgttgggtagcaacttgccctgtaatagatggagagctgttttctccatggctcctgcagtgtgagaggccaggggttatcaccatgcaagctttgtcggaagaggaccggaggctctggatggaagccatggatggccgggaacctgaacaagttgagggtgtttgccgtcaccactcttactcagcagaggactggaagtcctagtcagtgcagtagggcaagaaattaatataacaggcatacagagtggaaagaaaggaatgtgcagtataccttttactgagatatttggtgtagggccagttcctgcactgcttaaatgtcattaattcaaaggtttatcatcaatttaataatcacttttgaggagcaagagggaaacatctcattaaagataaagaaggattataaaatgcatt

SEQ ID NO: 464337 - DNA, 478 bp, Homo sapiens
tcggtaccccttctagaggttgtggcgggtattgtggcatcttagaaaaacacttgaatttgtcttccaaaaagaaagaatctcagcttcaggaggtaagagactttattagtatcctgaataaagtgttcaatttgtacatgatgctgtggatatgtgctggttgctctttgctagaaaatcttagggttagaagggacctgggaagccaggagattgctcctgatccctcatccagtgcctgatgcctggactgcctttgtgtcctcccatcccaccccatcctttgtagccttcccgcctgtcaaggtggaagacactgctggccgagatgaccacctccttgttgggctgccctgattgctagatgtcttcatttcatactgacatttcttttcctgtttctctcacccttggccttaattctgccctctgttactttaccttttgacttcctgcctcttatcagtgatttgaa

SEQ ID NO: 464338 - DNA, 1408 bp, Homo sapiens
gtcatgtatacatcacggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacaagggagtccgggtagagaaggaaaaggcattttcatgcgctgggtagctgcatccctgggaactctgcccggaatccttttctctcaaagactcctgtactttcctttttcaccaatgtcctttagcgaggaggtgattgctgctagatgccctgctgtcctgccttccacaggttccccagctccacctgctggaccagagaggcagaggatcaaaatgcaagggccagggttggaggagatatggtgttgggtagcaacttgccctgtaatagatggagagctgttttctccatggctcctgcagtgtgagaggccaggggttatcaccatgcaagctttgtcggaagaggaccggaggctctggatggaagccatggatggccgggaacctgaacaagttgagggtgtttgccgtcaccactcttactcagcagaggactggaagtcctagtcagtgcagtagggcaagaaattaatataacaggcatacagagtggaaagaaaggaatgtgcagtataccttttactgagatatttggtgtagggccagttcctgcactgcttaaatgtcattaattcaaaggtttatcatcaatttaataatcacttttgaggagcaagagggaaacatctcattaaagataaagaaggattataaaatgcatt

SEQ ID NO: 464339 - DNA, 1108 bp, Homo sapiens
tcagagcttcaagtacatgactgatgtggtgtatcccttggggatgggggtgtacacgctggttttgggaagcagggcacttggaaatgtacaagatacaatccaaacttacttgacacataaagaaccaggaaaatgtgattattttttaaaggaaaaggcaatcgattatgttaatcctgagatggcccagatgctgaagttatcagacaaatactttacttgttataaccaagcccatgaggtaaagccagagtgcaaaacctgtggaagccatgggtacgttttaaacaagggagtgatgagatgtgatttacattctaagaacaggcgctcctgtgaagaggaagcctcaggagggagtgagagcagaagggagcccacctgtggttgtctcagcaacagcagaagaacctgggccgctgggagtggagttggagagaaacaggttgatttggaagttcttctgcaggtagaacggaaaggcgaattctgcaagatgctctggggtccactgagctcagctgctgaggctcagctctttctgtggcttcttcttgagcagcctgttgaccaagatgtggcccatgccactccctatattcggagtccattttctgatgccctctctcagctcttcgcctgcactcatctgtgactgcctggtactgctaggaagcctctgtttgtgtctcatctctccaggtggactggagctcctgggggtcctttcctttgtgggggttctcaatatcagaatggagtcgcttatgtcaaaccctaacaaaatggaggtggaggtcacgaattggagcctatatgcgtgcctgtaacaggacttgtcacaaggaatccctgcacatatgtgtatgatggggactatgccaggaactcctcacatatggaggattcgaggtaagccatttgctcaaggacacttacccagcaatggcagcctccactaatgagacatcgcgaactcctgtaatcaatggtctttgtttctaaacagcttatgtggaattctccgtttttttgtctgtaaaagttttctttagccccagtctctttggatatgcctatgattcatcatagcacatgtttccca

SEQ ID NO: 464340 - DNA, 1068 bp, Homo sapiens
tcccccacaatgggagagggcagattttcctcactcagtttactgattcaaatgctaatctcttctggaagcaccttctcagacctactcagaagtaatgcttcacagctgtccagatctgcagtgggcgtagatggtggtttgagggtggcctggaagaagccagaaaatggtagtctggacttgagagaggagagggatgaggtgtgtccagggaggtctgcagggggcagtagatcacagagcacagggaggatgagcgcggagggtgcaggtgacagctctgttgctatgtggggcactctgggcccttcggcagggaacctggaggcaagaaaggacattggttggaagggaccactggtgttgcagagcaacagtctcgaaggctctcggaggctatggctgagaccacccccagaggcctgcttcatatgtggcatgaagcccgtgaggtgtggggagactgccctgggagtcagagttgggcacgcacaaggtgaacgatgcctgctgccattggatgtcatagacctgaggcagcactgtgaacagaacatggaagggtgagagtggatgcatgggtccacacatgtgacaatgggcttttgatagcccagagttctgaacttattctgtgaaaaatgtgagtgagagtcaccctaagtcagaccttcagcaccattttaggcacccataccctaggatgcacatcgtgggattcgtactctgggatccacaccttgggatctcaccctgaccattgcttcgtgtgagagcttgagtattcatgctgtgatgtgtggattatcacccaaagaaacaaggatggagttttcctgccatcgacatcactgactcacaaaggacagcttagaaactgtgaagactcctgagagactagaaggggctggacttgcttttaatcaggtttcaatgcagagacgggtgtcctgtcagttcccttattcagagacacgtttgttgtggcattaataaacaaagtcagcattccctggagaccaacaaaagcctgatccaatgtgagtttgtgcgtttctgtaaaga

SEQ ID NO: 464341 - DNA, 1619 bp, Homo sapiens
catatcccagcattatcatgcgcaccaggaccacatttatatgcactccgagggactcatcatggtaaatttcattcacctagcaacaaaaaaagataattgctaaaagaaaggaaacaccgaggatttcatgagatgtacatataagctgtgtaatcaccacaaatagttacagactaaatcatccttgattccttcttcttcaagtattagagtcattctactaccaagtaccgcagacatctgtcaaacctgtccacctccacaccaagcagcttagtaaaccaaccagctcatgcagactgttgcaataacttgtgaaaacttttgcaaatattttgtatttaggtgatttgggcacatttgagtagctctccagaaaggaagattgtaagggttgatggttgttttcaataaacatgagtctttccttttatgtgaattatgtcttacttcatttaagtatcaaaggagctttggaaagcccaagaataggcagtcagctgaaagagcctgctcaggtcagtattttgggtctaacaggctacaacagggcagagggtatggaggagaaggaagacttaagtcttctgtctgtcttgcctaaagttgtctgcctgactccagggggaaaacctgaaattatccagttggagagtgatgaggctgctggtggatgttgccataaacagtacctagatcatcaaggccttccaggatacagtaacagcatctccacatatgtggaggcactattctaccaagatataaaatgtttccgtgaaaaggagctctatccttcacaaactgagaaattccataatgatagttcaaagaactatattcaggtcaagttatgatgtcaattcaaaagtttcactaagtacctgttgcttttattttttaaagacataaccattgagtgaatgtcagtttccgttatttcttttccccaaaagttctaattctaacatccgtgtgtttgcttttgtttttactgactactttatggaataacatgacattttttagatgggaaacttcttaccttttaaggaaaaaaatgttttaatgctttgggtttgtgattattagcaaatgaaattttaaaatcagtttaatatccaaaatatgaactctgactggcagtaaaaaacttctatgtcagcgagaatgtttctaactgcaaatcaagaaaacttagtgtcttcagcaataagtaaacatactagttcacgtaacaagagttccagaggtatggtgattcctggttaatccatcaataggtcatcaaggattcagttcttttcatctttccatatcctgccattcttggtgtacaaactttgccttcaaattagctcctttgattatttcaaaatggttacaccaattctagcatcaaagccatgtccaacagattgtgtcttcctgcattactttcttaggaacagctaaatcataactaattttgggagacagcacagtttttaattttcacattttactgctctaaacatttaatagcattttcattaacatttctcttcctcttgactaaattatatattttcttatttatggcttttgtagttcagctctactaaatcaaggaggta

SEQ ID NO: 464342 - DNA, 2887 bp, Homo sapiens
ggtctctacatgtcagaacacagaagttgtgttttgtttcgttttgttttacagagctgtgtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatcaaaacgggctgtgagttt

SEQ ID NO: 464343 - DNA, 579 bp, Homo sapiens
  misc_feature (6)..(6): n is a, c, g, or t
  misc_feature (10)..(10): n is a, c, g, or t
ttgttncccnttgtttactactactatgctgcgagaagacgacagcaggggattcagataaaaatacccaggtccatagtgaaagatgtttttcagtatgttacttatggtttagctactagccagggaggtggtagcccagagaaggcaaaccacatacagatcacctggagttgattatatgagtctatgcttttgagctctttaggcaacacattctcattcctgtcattatcagttgaacctccatgccacacatttctaagaattaaatgcctagatggattaaatgtagtatgtgaatgttctatgtaaaagccaatagagtatacaagtgacttgaatgatttttcctaacttgtttgcaactgatagctcatattgaatgtttttatgtaaactttgtatcgttgggaagaattacccaatcagagatttatattttcataaatgttacatttagttaaattttgttacagagttgttacactagaaaattatttcagtcttcaaacaatatacagtcttgtgtatgtattatttgtatgaataaaagataaactacttagattggcgtgc

SEQ ID NO: 464344 - DNA, 676 bp, Homo sapiens
  misc_feature (24)..(24): n is a, c, g, or t
  misc_feature (62)..(62): n is a, c, g, or t
  misc_feature (90)..(90): n is a, c, g, or t
aaattttaagggtggaccaacctnaataagaagaagcctaatggaccgttcgggcatggcancgcggtacggtaaaagcttggatccctnctagagcgggcgccctaactaacttacttatggctgcgagaagacggacaagcaggggattcagataaaaatacccaggtccatagtgaaagatgtttttcagtatgttacttatggtttagctactagccagggaggtggtagcccagagaaggcaaaccacatacagatcacctggagttgattatatgagtctatgcttttgagctctttaggcaacacattctcattcctgtcattatcagttgaacctccatgccacacatttctaagaattaaatgcctagatggattaaatgtagtatgtgaatgttctatgtaaaagccaatagagtatacaagtgacttgaatgatttttcctaacttgtttgcaactgatagctcatattgaatgtttttatgtaaactttgtatcgttgggaagaattacccaatcagagatttatattttcataaatgttacatttagttaaattttgttacagagttgttacactagaaaattatttcagtcttcaaacaatatacagtcttgtgtatgtattatttgtatgaataaaagataaactacttagattggcgtgc

SEQ ID NO: 464345 - DNA, 7195 bp, Homo sapiens
ttcagttacccacagtcaccttcagtaaaccagttatatgagatggcttatgtgctaaggagagagagaggacatggtgaaaaatatgggaatatccgaatccctggagaagttgaagcctcagagtttgaaatgattttggatgccgccatagaggcaaagctggagaccaagttgctggaggagtggtactgtcgagatgagaactcggtgccagcagcctattacctcagacccaagtcagaaatgctgagaagcaatagaaatgcaatgcagccttctaccaatgctgaaaacgagaagacatggcaagagatatcagatgagatcaagaagatatttaaggctgctgtaaagctgttacacgaaaagggtaaaatgaaacacagccaggctaagaggtacctgttctcagctatagaggatgagtttgactttgctctgggaaaacaaactccagcatttctaaagaagtgtgtttgctacattaggaaaattgctaacattgagcgctttgtgaaaatcccagagatgggaaaatacatggatataactggaacagaaccgaggattattcgggacccagaagcccaagagaagctgataaaactcagggatgaatttattcctactattgttgcatcatctaatctgagagtgtacacatctgttactcattgtgacatgaaactaggctactcccaagaaatagaaaatcattacatcgaaggacttggtaaacaattttatgaggacatgattgatataattcaggcaacgatacaacagaattttgacactgaaactgatacactctatgatgaaatccttcaacattcatcattatgtaaaacatacgcctccttctatgagtacaaatgtgaatctctaaacatagtgcataactacattcttccaagcaaagctggacacatcaaccctcttattatatatggtgggccatgcactgggaagacccttctgctagctgaagtagcaaagaaggcttatggctggctacatgaggacacaggaccagaatctgacccagtagtcatcgtgagatttctaggaacgacagacatgagctctgaccttaggactctccttctaagtgtttgtgaacaattggcagttaactaccggtgtctggttcaaagctaccctaagaagatccatgacctctgtgacttatttataaatcttttgaatgagtcttcactgcagagacctctagtcataatattcgatgcactagagcagctctcagagaatgatgatgccaggaagctttggtggctcccagctcacctgccccgctttgtccggatagtcctttccacgctgcccaacaaacatgggatcttgcagaaactaaggtgccttatccatgaagaagacaactacatcgagctgattccccgagacaggaagatgtgcagccaggtcctcaaacaccagctgctgcgcgtcaaaaggaaggtcacatcaggccagcagatttatgtgaacaatgcattatccaagtgcacactgccaatgtttgtgaacctgaccttcagggaggtgaggcactggagatctcacaaagacgtcgatgaatcctccctctctgtcaccgttcatgaaagtatagagcagttattctggtccttggagaagaagtgtggtcagaaactggtctctagggctcttggttacatcaccatggccaaaatgggtctgagtgaaatggaactggaggatgtgttagccctagacaacagtgtaatgagtgagctcaaagaaaacaccagacccagcaatcccctgagagtaccttacttgtacattgcaaggctcaaggagggtctcagtggatacctaatagaaagacatgtgaaaaatgtcacactcctagtctgggccaacagacacctgcagctcatagcccagaagctatatctgcaggatgacaatgacctgcgtgaaatgcacaccatcttagcagattattttctgggggtttggtcagggggcaggaggaaagccttctgccttgaggacccctacttgaatggctgccttgacttggagaacagaagtttgctggaggaagaaaagcacttcatggaacaggcttcctttgacaggcaggctccagaccagccctgggttttccagtgtaatcccctggaacctgacatctttttcgttaatcatcggaaaatgtctgagctgttgtaccacttgacgaggtgtggaaaaaccgatgacctgctttacggcatcatcatgaacttcagctggctttataccatgatcaaaattggccagtttgacaaagtgctttcagacattgagctggcttacaactactcgcaagagaaggagctgaagttcctggccaacaccctccgcagcatcaaaaacaaggtcactgcatttcccggctccctttcagcagagcttcagcaaagactgctgcctgttgtaagctccctgcccaaacttagacatcttcttttagagtgtgataaagatgggcccaaatattgctccattgtaccactgcattcatccatggatgtgacatacagcccagagcgtcttcccttatcatccagtcacctgcatgtcacagagatcctgcctacctgtaaccccagcactgtcctcacagctttagaaaatggttccatcagcacctgggatgtagagactcgacagctactcaggcaaatcaccacagcccagtctgtcatcctgggcatgaaactcaccagtgatgaaaagtaccttgtggtggctacaacaaataacaccttgttgatttatgacaatgtcaattcttgcctcctgtctgaagtagaaatcaaggggaccaagcatggaagcagcgccacctacatcaatggatttacactgtccgccaaccacgcccttgcatggctcgaagccagcaaagatgtcactgtcatcgatctgctgtacggatggccgctttaccagttccactgctggtatgaagtgacgtgcgtccagtgctccctggatggtctgtatgctttctgtggccaatacctgaacacaaccaccatatttcatttagggagtggagaaaagttatgtacagtgacatcagaattttcaggtggatttgtgaagtttcttcttatcttggacacagctcaggaaatggtcatggtagacagtgaaggaagtctttctgtttggaatactgaggacatttccagcccccagctgactgatgactttgattgccgaagagaagacagtgaggtggtcagcattgagctttcagaagaccaaagtgcagttctgatctgtaaagccctcagcattgagctcttagatactggtctgtggaaggtggctgaaaagttcagagccaagcacaacgaacgctttatatctgccgtgctgtctaaaaatggagattgtatcatcgccaccatggaaaatacctcagctgtgtttttttggaggcgggacacaggacagtgtatggcaagcttgcaggaaatctcaggttccattgttaagttagtgaaatccagtcaccacaatatgctactgtctttatcaaccagtggtgttctttccatttgggacatagatataatcacagctatgtccaacatagataagactggaaaacccatccaaagtctgttgttgcctgctagaggggaaatcatttactccctggatggatccgattgtgttcataagtggaacttcagcagtggcttcatcgaagcagtattcaagcatgaaggaatagttgaacactgtgtgttaacatccaccggagatataatggtgacatcagatgacaaaagcagccagtatgtctggcacaccagcagtggtgaaaacctttttcgaattaacgggcagagaatatctcagctgctgattacacacaatgaccagtttgtggtctcgctctgtgaggaaaatgcctccagggtttggaggctcgccacaggccacagggtctgcaacattctgaccactttgcagaatgcctttattacctccgcaaataccttcgtggtgggaatgactaaaagcaaagtgttggcagtcagtctttggacaggaagtatcaccaagaaattttgctgtgaagatgggaccaccatcgtgaattttaaattaatccctgactgtcctgatatcatcgtgtttatcacatcggccgagactgtgaacatctggagtctgacagatgaagtgatctgtcggcgcgtgcaacttccaaacaacttcttgaaaaatctggaggactttgaaatttctcccaatggaaagctaggcattatagccaggggagatgaaaacatcaatgtgctagatttatacagtggtaaattgcgggtggttcacgcctctgggatcatctggcggcagaggttgtctcgggatggtcgctacctggtatacatttgtttccgaaatggggaggaggaggatgaaaatggtgcaatattcagtttaattgtaatgagactggcagatggcaaaaatatcggtgcttgttccctttacaaaacaccaactttccttgcactctcccagaggcacctgaacatcattgtgggctttgatgatgggagtatagggatctacacggtagtagaccgtgtagatgctgcactgaaaatcaaaattgccacttcaaatagcagacaaattttcaacaatgcaacacacacctccaggccaaagtgtaacagttattgttttaaaatatctgtggattgcttatggagagagtccactgaggtctttgcaagagacagccccatcacagttagtgactctactgagtccaatgaagcaacaccctccaagaaacacaactcttgttatgagcgggtatgctcggccctagaagccaggggccacagctatgcccctgataactgacaaaatgttttccagctaagcagaaatatgtgatccacgtacagaagggaaaaaaatgtgccccaaatgataaactattcatttattaaaaggcaggagcgatgctggaattccagtgttttattaagatgttcatgaaatggacaaataggttagtcttgggtgtggtctttttgtcaaagtgtatccagaatgtcagaatttctagtagtaatatttaaatggttacttcatctgaaaggcagaggctaaaagtttttaaattagctgtgtggtgaggcagcataatacatcccactggttaagatgagagaggctagagttatatacagatcatttggatgggaattagttctacaaaaatcagctgaaatcatgaagacaaagagctgcttgacttcaaatgattgtgtgataagtaaacacagccttaatctctctttacattttacagtcctgacaactgtgtacacctagtctgcagtgaacggtctaaaggtgcaaaatatgtaacaaaaatacccaagtgtattcccagtttcccgagagatatgacctgaaacatgagactgtggactggactgggacaagaactaactaccactatcatagggctactgaacatggagagtcagtctttattaaaagacagttgcaacaattgcatgcgagggtttctgtataacagaatatatgatttttaaactatttcctgggttgcaaaagaacacatttagtaagaaacaacaatcttttcgcatctttttgaaatgcatatttgtgctgggtgtaaagaagattacaggaagggcattacaaatctggtcaaaacacctgtccatttccatcattgtactaacagaagtctgtactatttggtcagtttgtatggaagcataaatattccctaaattcctgcagttagtcttcatagaaagcaagctttctcaacatgccatctctgagatactgatgacgtttgccttactcacattccttctctttcctgtgtaaaatgcagatagatgaccaaatactctgggataaactgaatatgcctgtctttgtgctaaaatattccataaatcttaagggtgtccaaaagttctttattgtccttgtttgtaatcactttcttacttctacacaccatctgtatgcttctttatctgttactcttcctgattgaggactcttctgagccttttatagtcctatccatttcaaagcagaagctgtggaatggtattaaatattttttaaaattaattcacctgtttaaaagaaaacattgcatctcaaaaggtgaagatgattgttctttcttccatatcctccttacggcatgtccttggataacttttcaaaaggtatccacacttttggttgagtttagttttcttagaaagtagagaagtaacactttactagaataatgaacaaggaattgatttgctctaggcccagctctgccataaactcattgtgtattcctagacaggtctttaacttcatcagtgtgttgtttttgtgaagtgcaaaataaagatagtgatagtttctgctgtagccctcatagggacattgggaagcagtataagaaaaacttcagcaacatcatgattattgatgctaataggaaaaataaattcatgtaacccatagagaatccaggtcaattgtatttcctcttggaaagcagtttaacatgtaagcgttcaaagaggggattcagataaaaatacccaggtccatagtgaaagatgtttttcagtatgttacttatggtttagctactagccagggaggtggtagcccagagaaggcaaaccacatacagatcacctggagttgattatatgagtctatgcttttgagctctttaggcaacacattctcattcctgtcattatcagttgaacctccatgccacacatttctaagaattaaatgcctagatggattaaatgtagtatgtgaatgttctatgtaaaagccaatagagtatacaagtgacttgaatgatttttcctaacttgtttgcaactgatagctcatattgaatgtttttatgtaaactttgtatcgttgggaagaattacccaatcagagatttatattttcataaatgttacatttagttaaattttgttacagagttgttacactagaaaattatttcagtcttcaaacaatatacagtcttgtgtatgtattatttgtatgaataaaagataaactacttagattggcgtgc

SEQ ID NO: 464346 - DNA, 1234 bp, Homo sapiens
catctgtatagcgggacaggatgtcacagatgtagagattcaacaggatgagagtgcctgagctgtgacgggtgcccagaacatgatctcaggaacacatatctccttttccagccggaagtacctgagagagaccccagaaggtggataagactgcagagagcagggagcatgaagcaccttgcccaaggtctcaccaggcaagagaagggcggagaagggcggcttcttcatggattgtaaatccccaaagcgtgcaaacatctgcccccatctccctggaggtggcctgttctccacgccaccctcacaggctgcctggcggactctcctcacagcactgtgcttcccggggcccacttgtacaggccccatgcgagaaggacctcgggcagtgtataatcctccaagggcccacaggaacagcagtgacaactgtgttatgaagcacctactatgtgctggggacaagaatggaacaagaagacatgctttgccctcacccctggagggcagcttccagccagggaggcaaatacctcctccccagactccttccacagatccccaaactctgcctctctccttcagatccctgctcagatgtcaccagctctgtgcagcctccctgccaccaagtctaaaattgccatagtcccctcagttcctcacccctctccctgctttctttgtctgtctcatccatgaggatgtgccctctgggaagggcaggcaggagctggctattctgttccttgccctgtccccagcaccgaggacagtgccaggcatggaggaaataattgctgaataaagaaataaaatcgacattctatgagacataaagcacagttcagacacatggagtgaggggtggttccattctgactgcggtgatcccggtggtctctctgagtaggtggcattgagctgagacccagtgatgtgaaggactgagcgtgtgtggaggaagagtattccaggtggaggaagcagtaaatggcaaaggccccgagacagggctgagctctgtgtggcccagcacagggcctgacactcagtagatgattaataaatatctgtggaatgagaacatgagcgtctaccccgcttattgtataaaagcagcagttgaggttcagagagggcccctgtacctagcatagcatctggcactaagtcaagctcattgagtattagtttatttattttaaatataaaggttttaaataaa

SEQ ID NO: 464347 - DNA, 961 bp, Homo sapiens
gctgctctgagataacctcaccctaaattacgagtacacaactgaaaaactcaaaagggaaggcgaggagctgagaatgtaaaccctcaactaccagaccttccacagccataaacggaccctcctaggagttggacttcagaggcaaaagcatgtttgcgatgaggtaacctgtctcggtgtctttgcatcctgctgtgccccaccgtgttttgaaagagggttgcagagtcactgaccctgtgggatggccaaactgcacatgcccagcgctctgcccgccccagggcacctctcccacctgccaaggaacctgctcccaccctgaccactcgcagataatccaagactcactatatcttaatggaaaaccacagtcacattggcaaatgtttggacaacccgaatctgacctccagaaaggagagccccgcgcaccccctgctcaggaagacttggctgtgcgagtgaaagtgtgcagctgtgaggagaaagcccttcctggcctcctacaggaatgtcttctgctaaatgaggttctctgtcagccctacagctgcctcagacataaaaaaggtgtatggggaaagctccagggtcctgagcctatcgaacaggtgatcctgagccaccccagccattccaggacgctcccattagtcactcagaagctgttcataagcttctctttcaaatcacccctcgtgtcccgggaagaaggggaaatggagacatgtgttcgccaaggaggagaaaaccaaacaggaccctgtgcctaccttaaaatgcgaaagtgctttatgaaacaatgagcttctcttgcaggtcattctccagaatgccaattacatacttattcttcctgcttgagaaacgggaaacatattccgttgtccaggagagccatctgcattgtggttgctgcaccttcatggaaggagggaaattgtgacttgcagtc

SEQ ID NO: 464348 - DNA, 998 bp, Homo sapiens
aggctttagcgtcagtgctacctgggggatggagccagtccagaaagggccaggcagtaggagcttccactgcgtgtggaagtctttccacctgagtggaattggctgtggcttctgtgttcagagtggaattggcaagcagctgctatgttcggagctgactgtgttcgtcagaccagggccagatggacgctatgtctcccatcagtcagtctcagtttattccactcggggagatcctctgcttggccatctcagcaatgaactcggcaagaaagcctgtcacccaagaagcactgatggagcacctgaccacgtgcttcccagtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccac

SEQ ID NO: 464349 - DNA, 411 bp, Homo sapiens
  misc_feature (29)..(29): n is a, c, g, or t
ctgatttttttaaccttcccggattcacnaaacagaaatataggcctttgaatctgaagtggacaaaggaaagcaatttccagtctggctggggcacagcattaggtgattgaaaaggtgatgtggacttgtctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccac

SEQ ID NO: 464350 - DNA, 4740 bp, Homo sapiens
gcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacggaattgaaaaaaatgtttctgcacctgtagagatcaccaatctggactgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccac

SEQ ID NO: 464351 - DNA, 858 bp, Homo sapiens
cggccgccctcgggcttccacatccgctgcctgggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccagtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccac

SEQ ID NO: 464352 - DNA, 4691 bp, Homo sapiens
gcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccac

SEQ ID NO: 464353 - DNA, 1461 bp, Homo sapiens
tgagcaccgaatacaaacgctgaaggatgatgacgatattcgcatgtacatgccagctaaataatttaggagcctgcctaaatgcgattggtctggatggaagatcaaaccagccacagcattcccttaagccaaagcctattccagagcaaggcctaactctcttcaattctcttaaacctgagagaggtgaagaagctgaagaaaagaagttggaagctagcagagataatgatccttctgatggatctgagcaaagcaaactgaaaaccttctggaaaggactcaccatcctagatgtcattaagaacatttatgatttctgggaggagtttaataaattaccccagcaattccaatcttcaacagccactaccctgatcagtcagcagctaacaacactgaggcaagaccctccatcagcaaaaagttcaggactcattgaaggctcagatgattgttagcatttttcagcaataaagtatttttatttaagtggaaaggcaatgctgtttttacataaaatgtttttagcagaatactgtaagttctataatactgaagaagatatacagaagacaaatcaacacatgaaaagaagttcagcataattaaccatcagggaaattcaagttaagtccacaatgagatatcctacacacctgttagcacagctagcatgaacagtgacaccaaataccggtgtggacatggggaaagtggatcactcatacagtgctggtggaattgtgaagtgatacagacactctggaaaaccgatcgtttctttaaaaattaaacatgagactactacccagaaatcacattcctgggcatttattccagagaaatgaaggcttacattgattcaaaaacctgtacacaaatgtttatagaggatttatttgttataacctcaacctggaaacaaaccagaagtccttcaacagcaaaatcaacctttcccttgccgtgagtaaaagaccaacttgcatctgcttggtatgcagtaaaaaatggagcagattgcacagtgactggagaaatgaatgagaagtccagctatgaaaaaaagtcagagacaaaaatgaagataataaaatatattttggatgagtgcaattgcctaaatatgtaactgtcaagctgattggacactttctatggatttattttcaatttcactgattctttcatttgttatctcagttatgctatttagcacatcaaagcactaacatatatgtgtaaatatatatgttattggtgctctaaaactgtagcctaatttcaatatatgtttgagtatatattgaaatttgatatatattcaactatataatcaaatatatattgaaatttgatatatacatacaattttagagcactaatataattatgctagtactttcagttcacaccaaatttaaaatggaaatacaagaagtgtacccacatata

SEQ ID NO: 464354 - DNA, 1691 bp, Homo sapiens
ttggagccgctttctccctcctcttaggcttgagatccagcatgggtgtactccaaaaatcattcctttctgtgtttccagtcaaaagccagcagagcgcactggtcaccagagaggcccagccaaagaccaggaccctgcaggtggccttgccatccacaccggcagagccacccccaccaactcgtcagagccatggcagccatggctccagcctgacccaggtgtccgcccccgctccacaccccggactgcatggaccctccagcacccctccttcctcggggcccgggatgagcacgcccccgttcagttctgaagaggactcagagggagaccgtgtgcagcgtgtgtctctacagcccccaaaagttccttccaggatggtgccccggcccgaggatgactgggactggtctgacacagagacctcggaggagaatgcccagccccctggccagggctcaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcagctttctgaagatgagagtgacttggagatctcctccttggaagatcttcctctggacctggaccagagagagaaacccaagcccttgtctcgctcaaagctcccagagaagtttggcactggtccacagagctctggccaacccagggtccctgcctggtgattcaccccagaagctagctggctagagggttagcctggctggggccagctcaggtccacttcaacagaagaggctgctgggcctcttgtcttcacaaacaaccaagagatcatcctcttggagagaagcagtgcagggaatggatatgatctcatccctcctgacctgtgaggggccctgctgtagatggccacaggtgcctgactaggagcccctaggtccccaggcttgagaaagggttaaaatagaacctccaggtagttttcttcctctacctccacatccccccaagactgaaaagagtcactaactctcttttcccaagccttttataaaactgcaggaacactgtggagatggttcctatctggggtccttttggggacatatgcctcagtcagtcattcagtgattgatccaaaattatttactgagtgcctacctactctgcgccaggctctctagcctctcactactgagttagggtgcaggcagaggctggggcagaatgtttacagccagtgccagcacaaggtagtaatctagtgacagagaacagggtgttatggggagcatatgagaggccatctatcccagcctgggtgatcctggagagtttcccagggttgtgatatgtggcaggcctactcatgggtgggaagggaggatggccacttggctggaccttgtatccccaaaggaccacacgtgtaatttttgatattatttccaaaatcaggttttatacatagccattgtatatttttagtgtgaaaaacattaatatattatatgcaaacatttaaatatagtacaatgtttttaactctggtatgtatttcattatttttggagctttcagggggttgggagggaaggaagcaactgcatcttaattgtgtcagtttaggtcttttggga

SEQ ID NO: 464355 - DNA, 1449 bp, Homo sapiens
attaagtttgcacagtcacattttcagaatatgccaagcctctgttcactgggtacctgttggcctggccttctctgtctccttttttgtggttgctcagccttcttcctcctggcccttctgctcattccctctgtccacactggagcctggacatgagccacaaaactgagatgttcattttctaggcttctcccactgacacagccactttttcaccttccaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcagctttctgaagatgagagtgacttggagatctcctccttggaagatcttcctctggacctggaccagagagagaaacccaagcccttgtctcgctcaaagctcccagagaagtttggcactggtccacagagctctggccaacccagggtccctgcctggtgattcaccccagaagctagctggctagagggttagcctggctggggccagctcaggtccacttcaacagaagaggctgctgggcctcttgtcttcacaaacaaccaagagatcatcctcttggagagaagcagtgcagggaatggatatgatctcatccctcctgacctgtgaggggccctgctgtagatggccacaggtgcctgactaggagcccctaggtccccaggcttgagaaagggttaaaatagaacctccaggtagttttcttcctctacctccacatccccccaagactgaaaagagtcactaactctcttttcccaagccttttataaaactgcaggaacactgtggagatggttcctatctggggtccttttggggacatatgcctcagtcagtcattcagtgattgatccaaaattatttactgagtgcctacctactctgcgccaggctctctagcctctcactactgagttagggtgcaggcagaggctggggcagaatgtttacagccagtgccagcacaaggtagtaatctagtgacagagaacagggtgttatggggagcatatgagaggccatctatcccagcctgggtgatcctggagagtttcccagggttgtgatatgtggcaggcctactcatgggtgggaagggaggatggccacttggctggaccttgtatccccaaaggaccacacgtgtaatttttgatattatttccaaaatcaggttttatacatagccattgtatatttttagtgtgaaaaacattaatatattatatgcaaacatttaaatatagtacaatgtttttaactctggtatgtatttcattatttttggagctttcagggggttgggagggaaggaagcaactgcatcttaattgtgtcagtttaggtcttttggga

SEQ ID NO: 464356 - DNA, 393 bp, Homo sapiens
tcccactgacacagccactttttcaccttccaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcaggtaggatgtaggatgcttagagtttactctggaattctctacagaaccagctctgagtttggggggcctggggtgaaggttggggagggcccagcaagtgtcatcctttgccctagtgggacattgtgggtgacctccctctgcccctgtgcacatggagagatggccagtttggaatacttgtatccaagttaacattaaaaagccttttggttcatta

SEQ ID NO: 464357 - DNA, 985 bp, Homo sapiens
gtgatggtaaaactggcttgcttttgtgaggtattattcactgttagcttgttctaaagggagctgggtgatggcatgcagcagaatccatcacggagggtacatcacccaccagctttccatctgcagatgttgcccattgtagagcagcatgctgcctgttcaggcactgttgccaaacagaaggttctcttggcagaagaactggcacatgctgggctctgcaggctgtgcccccgaaccagctcttccacattggcaaatgggcatccttgaaattgccctgccccatcccccacaggcctcctaccacccaaacagatgggcacacgtgaaagaattcaaaggtgagccagtggtagaagaaaacaactttattgagatggcagtgttacggcttcgtgactgctcccgcagagcagggctaccctacaggctgtgtcaagagcagcagctcaggcacagctcacagttaaaaaaggacaccagtcatattggattagggcctcacctgctccattgtgacttcatattaactaattacatctacaacaacctaatttccaaataaggtcacattctgagcttctgggagttaagaccccaacatgtaaatctggagggatgcaattcaacacgtaatattccctaacacaatatttccataacagtctgtagcgtcttcttcaggctaagggattggggcctcatctatcagagttgtaataaggaacaaaggttgttgaaggtatccaaagggcaatgtaacccaaaaatgtgaacaactggtatatatggagcatcaggaagagtagctaatggatgtggagcttaataccaaggcgatgggttgatttgtgcagcaaaccaccatggttcacgtttacctgtgtagcatacctgtacatcctgcacatatacccgagcttaaaagttgaaggaaaataaataaatttaatataaatatttattttgaattctttat

SEQ ID NO: 464358 - DNA, 1123 bp, Homo sapiens
ttattactgcaaagggagtttctttttatcagcattcatgaaatatacgaatagtcccagtgtgtattaaaataatcccacataacaatcacttcgatgaatattgctttctttattccaggctggtttctgtttcctgtcttcttgtgctgttgtctgatagatgagaattttgtattcttatttactacttctatggcttgaatgtgtctcccaaaattcatgtgttggaaacttaatccccaatgcaatggtgttgagaagtgggatctttaataagtgactggctcatgagggctctgttctcatgaatggatttatgctgttatcacaggagtgggctcccgataagaggatgaattcagccctccttcctcttctttcacgtgttctcttgcccttccaccctccaccatgggatgacacaccaagaaggccttcaccagatgtgggcccttgaccttggacttcccagcctccagaactaaggagaaaccaactccaagttcttattggaatatttacagggtactggaggggctcacagtattaaggagaagactccggcagcctctgaaagaaagaaaactagggaagctctggaaacaccaataaacgacctctgtctaggacgctgctggtggatgactcaatgtgatggttcatttcatgtgtcagcttggatgggctatagggtgcaggtctgacctggtgcctgtttgtgtaaagttttattggaacacagtcatgcccatttctttacatattgttcattgctgctttttggctacaatggcggggttgaggagtcgtggcagacacatttggcccccaaagtacaataaattgactctagccctttgcagaaggtttgccatcccctgctctgctgcatcacttcacacaccaacaaaggcagcagctcaagtaaaggccagacttgatctaacaccagcaacagtaaacaagtgggagaaaaacaaacatctctccatgaatccaattgcacaagagaagggaaaagatgtggttggagttgcccctgatactcacattcttctagaaagaacattcctcagcctcccactgtatgcaaggctctgagcagctgatcgtccagact

SEQ ID NO: 464359 - DNA, 1082 bp, Homo sapiens
ttattactgcaaagggagtttctttttatcagcattcatgaaatatacgaatagtcccagtgtgtattaaaataatcccacataacaatcacttcgatgaatattgctttctttattccaggctggtttctgtttcctgtcttcttgtgctgttgtctgatagatgagaattttgtattcttatttactacttctatggcttgaatgtgtctcccaaaattcatgtgttggaaacttaatccccaatgcaatggtgttgagaagtgggatctttaataagtgactggctcatgagggctctgttctcatgaatggatttatgctgttatcacaggagtgggctcccgataagaggatgaattcagccctccttcctcttctttcacgtgttctcttgcccttccaccctccaccatgggatgacacaccaagaaggccttcaccagatgtgggcccttgaccttggacttcccagcctccagaactggtactggaggggctcacagtattaaggagaagactccggcagcctctgaaagaaagaaaactagggaagctctggaaacaccaataaacgacctctgtctaggacgctgctggtggatgactcaatgtgatggttcatttcatgtgtcagcttggatgggctatagggtgcaggtctgacctggtgcctgtttgtgtaaagttttattggaacacagtcatgcccatttctttacatattgttcattgctgctttttggctacaatggcggggttgaggagtcgtggcagacacatttggcccccaaagtacaataaattgactctagccctttgcagaaggtttgccatcccctgctctgctgcatcacttcacacaccaacaaaggcagcagctcaagtaaaggccagacttgatctaacaccagcaacagtaaacaagtgggagaaaaacaaacatctctccatgaatccaattgcacaagagaagggaaaagatgtggttggagttgcccctgatactcacattcttctagaaagaacattcctcagcctcccactgtatgcaaggctctgagcagctgatcgtccagact

SEQ ID NO: 464360 - DNA, 493 bp, Homo sapiens
atcagcattcatgaaatatacgaatagtcccagtgtgtattaaaataatcccacataacaatcacttcgatgaatattgctttctttattccaggctggtttctgtttcctgtcttcttgtgctgttgtctgatagatgagaattttgtattcttatttactacttctatggcttgaatgtgtctcccaaaattcatgtgttggaaacttaatccccaatgcaatggtgttgagaagtgggatctttaataagtgactggctcatgagggctctgttctcatgaatggatttatgctgttatcacaggagtgggctcccgataagaggatgaattcagccctccttcctcttctttcacgtgttctcttgcccttccaccctccaccatgggatgacacaccaagaaggccttcaccagatgtgggcccttgaccttggacttcccagcctccagaactgtgagaaataaatatttgttttttataaattaca

SEQ ID NO: 464361 - DNA, 819 bp, Homo sapiens
ccttggaaaatggagcatgctgccattccctttcacacacggaccccagagatgtgtcagggggctggggtggtgcatctgagctccttccagttcccaacgcagacactgctcaaagcagagttcccacaatgttctctgctggttgtaacccgctctattccacctctttgcagatccagtccttgtctctcaggaaggtggaagggatccacaaggtgccaaaggctgtggacacagaggaggactctccagaggaaggtgggaccttactttctttcctgggtgtccagtgcagaaacagatttgctgccctcctccttgtttagtttgtctctacttaactgtatctggacatccgaagctggagtggagggaactaaggacatgaaataatatttcttaacaccttctgtgtgccaggcatgtgacatgcaggtactaacatacaatctgctggtttagtgatggggaagcccaggcctagagagggtcattagcttgtccagagtcacaaagctagcaggtaactgagtgaggatttggagggacgtctgattcacagcctgccctactgactctcacctgcgactatgcagaacagtggaagataactcgctgagttgacttaaaatggcctttgctgtttttttctacattgtgagtgtgctgcagacaggtcccacagggcctgactaatgcataggaatccacctcggctcccttttcagagcattgggcacctgctgtttttattcaccctatccagtgattgactctgattcgcagacctctcaaccagatgtagccaagggatgc

SEQ ID NO: 464362 - DNA, 1910 bp, Homo sapiens
tgagtcggcctcgccagtgagcatgcgcgaggcccgagccgccgctgtggtcacatcggggctgagaccagtcctggccagggcagttaacaggaaggtctccggaggccgggattcgcggagggtccatcaggaggaagaaacctcagacagatctccggggagacagcgcgggatcccagcctcaggcgtgcgcggacagtgtgcgggtgagtctccccaaaagtggcgctcttgggatgtcgaggacaggtctgcctgtgtgtccgtgggctgctctcttcaccggtggcttggtagtcgcagagagcagaacccagcaggttctggggctgcctgggtgtgggcctcagtaagcttacaatcatggcagaaggtgacgggggagccagcacttcacatggctggaagcaggaagaagagtgagaagtggggaggtgctatacacttttaacaaccagactcacaataactcactcactatcgcaagaacagcaccaaggagatggtgctaaaccatttaagagaaaccgctagatgatccaattgcctcccaacacgccccacctccaacagtgggacttatagtttgacttgagatttgggtggggacacagatccaaatgatatcagtgtgttaaaaggaaaaggagataacagtgggaaatggatatttaacttcaatttgtgagtttttattttagagttctaaaattatgtcttatactacctatacaagtgctggaatattttctgtattaagtggtagatatataatatccgaatatcatacttaccttctttgaccttgcagtttaagagggcattttaagaaagtaaacaaacacattgatttttttttaaaggagaaatttttcagtaaacgatatagttaagtctagtacacaatgacaacaaccatcttgggttaagcattggcctacaaacagaaaaaaaccttcagggagatagatgctgatctaggcattgtgagaaaagctgaattcatttttaatcatgaatggcttttaaggaaagaagatttattaactaaaataaatagattagagggaattctcatctatgagagaggaagggatgggattcaacctggaaaaaatgatgaagttttagtgaactgggtaaggtagactcaacaattaatgatggataatgctaggacccagcaccggtaatgagcttgtattatgactcaatagcatcactttatcactttaacgcagatggaggcctaaataaccatagggcaatggttcttcttagatgcagaaggacacatttatataatcttagggaccccatctctgaggtcactcataatttatattaattcattattattgccattgccccaagaatagataaggataagacatcctgtagcacaggtagcagagatataaactattcttattcttgtgtcttgtctataggaagggagtgtatcctggtgtatgacagcatatagtagagaccagtgtcaattagggcctgtgaactgagacagggtgactggctaagtccacaacccattagaaacccagaaataatcaaatcatgagggatcatggaaaggaagctgaatttgctgagttttgccacgtgggcattgcatgcctatgtgattaaccaccaataaaaacctgggacatcaaaaaataaataagctgctttaattgccaagaattcacatgtggttgtatgcagcattactgggagattgaagtgtatctgcatgtgattctactgtgatggacacttgtaaatttgtgcctggagtctcctggaatttgccctgagaatctttttcctttgttgataagaatctgcatccttttgttttaataaacgataaacatgagtataaaagcttctctgagttctgagag

SEQ ID NO: 464363 - DNA, 2000 bp, Homo sapiens
tgagtcggcctcgccagtgagcatgcgcgaggcccgagccgccgctgtggtcacatcggggctgagaccagtcctggccagggcagttaacaggaaggtctccggaggccgggattcgcggagggtccatcaggaggaagaaacctcagacagatctccggggagacagcgcgggatcccagcctcaggcgtgcgcggacagtgtgcgggtgagtctccccaaaagtggcgctcttgggatgtcgaggacaggtctgcctgtgtgtccgtgggctgctctcttcaccggtggcttggtagtcgcagagagcagaacccagcaggttctggggctgcctgggtgtgggcctcagtaagcttacaatcatggcagaaggtgacgggggagccagcacttcacatggctggaagcaggaagaagagtgagaagtggggaggtgctatacacttttaacaaccagactcacaataactcactcactatcgcaagaacagcaccaaggagatggtgctaaaccatttaagagaaaccgctagatgatccaattgcctcccaacacgccccacctccaacagtgggacttatagtttgacttgagatttgggtggggacacagatccaaatgatatcagtgtgttaaaaggaaaaggagataacagtgggaaatggatatttaacttcaatttgtgagtttttattttagagttctaaaattatgtcttatactacctatacaagtgctggaatattttctgtattaagtggtagatatataatatccgaatatcatacttaccttctttgaccttgcagtttaagagggcattttaagaaagtaaacaaacacattgatttttttttaaaggagaaatttttcagtaaacgatatagttaagtctagtacacaatgacaacaaccatcttgggttaagcattggcctacaaacagaaaaaaaccttcagggagatagatgctgatctaggcattgtgagaaaagctgaattcatttttaatcatgaatggcttttaaggaaagaagatttattaactaaaataaatagattagagggaattctcatctatgagagaggaagggatgggattcaacctggaaaaaatgatgaagttttagtgaactgggtaaggtagactcaacaattaatgatggataatgctaggacccagcaccggtaatgagcttgtattatgactcaatagcatcactttatcactttaacgcagatggaggcctaaataaccatagggcaatggttcttcttagatgcagaaggacacatttatataatcttagggaccccatctctgaggtcactcataatttatattaattcattattattgccattgccccaagaatagataaggataagacatcctgtagcacaggtagcagagatataaactattcttattcttgtgtcttgtctataggaagggagtgtatcctggtgtatgacagcatatagtagagaccagtgtcaattagggcctgtgaactgagacagggtgactggctaagtccacaacccattagaaacccagaaataatcaaatcatggagagattagtccagggccaataaatatggattagggaagaatgtgttaactcagcaggccagggtttcttcaaccctgcacattcaaagagggatcatggaaaggaagctgaatttgctgagttttgccacgtgggcattgcatgcctatgtgattaaccaccaataaaaacctgggacatcaaaaaataaataagctgctttaattgccaagaattcacatgtggttgtatgcagcattactgggagattgaagtgtatctgcatgtgattctactgtgatggacacttgtaaatttgtgcctggagtctcctggaatttgccctgagaatctttttcctttgttgataagaatctgcatccttttgttttaataaacgataaacatgagtataaaagcttctctgagttctgagag

SEQ ID NO: 464364 - DNA, 2224 bp, Homo sapiens
tgagtcggcctcgccagtgagcatgcgcgaggcccgagccgccgctgtggtcacatcggggctgagaccagtcctggccagggcagttaacaggaaggtctccggaggccgggattcgcggagggtccatcaggaggaagaaacctcagacagatctccggggagacagcgcgggatcccagcctcaggcgtgcgcggacagtgtgcgggtgagtctccccaaaagtggcgctcttgggatgtcgaggacaggtctgcctgtgtgtccgtgggctgctctcttcaccggtggcttggtagtcgcagagagcagaacccagcaggttctggggctgcctgggtgtgggcctcagtaagcttacaatcatggcagaaggtgacgggggagccagcacttcacatggctggaagcaggaagaagagtgagaagtggggaggtgctatacacttttaacaaccagactcacaataactcactcactatcgcaagaacagcaccaaggagatggtgctaaaccatttaagagaaaccgctagatgatccaattgcctcccaacacgccccacctccaacagtgggacttatagtttgacttgagatttgggtggggacacagatccaaatgatatcagtgtgttaaaaggaaaaggagataacagtgggaaatggatatttaacttcaatttgtgagtttttattttagagttctaaaattatgtcttatactacctatacaagtgctggaatattttctgtattaagtggtagatatataatatccgaatatcatacttaccttctttgaccttgcagtttaagagggcattttaagaaagtaaacaaacacattgatttttttttaaaggagaaatttttcagtaaacgatatagttaagtctagtacacaatgacaacaaccatcttgggttaagcattggcctacaaacagaaaaaaaccttcagggagatagatgctgatctaggcattgtgagaaaagctgaattcatttttaatcatgaatggcttttaaggaaagaagatttattaactaaaataaatagattagagggaattctcatctatgagagaggaagggatgggattcaacctggaaaaaatgatgaagttttagtgaactgggtaaggtagactcaacaattaatgatggataatgctaggacccagcaccggtaatgagcttgtattatgactcaatagcatcactttatcactttaacgcagatggaggcctaaataaccatagggcaatggttcttcttagatgcagaaggacacatttatataatcttagggaccccatctctgaggtcactcataatttatattaattcattattattgccattgccccaagaatagataaggataagacatcctgtagcacaggtagcagagatataaactattcttattcttgtgtcttgtctataggaagggagtgtatcctggtgtatgacagcatatagtagagaccagtgtcaattagggcctgtgaactgagacagggtgactggctaagtccacaacccattagaaacccagaaataatcaaatcatggagagattagtccagggccaataaatatggattagggaagaatgtgttaactcagcaggccagggtttcttcaaccctgcacattcaaaggtaaggtttgtttttaggactagctagcttctgcagttctggaaacagtcttaccgtgaagagtgtttttgtatatctgaggccttgggtttatggtgaatgactgactttatatgcctgaggccctgagtcatgctgtatttatctgaaccatgtggtatcaatttaaccagatacgtttattctaagatatgatttatgctgaaagcctgcttttgttctagagggatcatggaaaggaagctgaatttgctgagttttgccacgtgggcattgcatgcctatgtgattaaccaccaataaaaacctgggacatcaaaaaataaataagctgctttaattgccaagaattcacatgtggttgtatgcagcattactgggagattgaagtgtatctgcatgtgattctactgtgatggacacttgtaaatttgtgcctggagtctcctggaatttgccctgagaatctttttcctttgttgataagaatctgcatccttttgttttaataaacgataaacatgagtataaaagcttctctgagttctgagag

SEQ ID NO: 464365 - DNA, 952 bp, Homo sapiens
tttgtttacctactcaagcctcagcaatggcggacacccctcccccagccagactgcctcgcagagcaatctcagactgctgtgctagcactagtctgttacagcttcccttcactaggaaagggaaatccccagaccccttgcacttccagggccagtcacttgccatttctcataacagcgtcagagagaaagaactgactgaaacgtttgagatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaagattttggtttcttaatttccacaaattccatgattagtactcaatttgttttcaatcttcagcaatcccctgaagaaggaagaggtggcaggtggtgataaaaataaactgtcctacagcatgtgacaaaagtcatccaacaagattctacttgcacaataagcctttcagtgggtcagaatgactgcctttgtctccataagttgattatcaggaaattagaaaaattctctttgaataaagattatgtttcttcaccttaagtttaaattgttcatagctgagccccttagcatcaataatggaaa

SEQ ID NO: 464366 - DNA, 488 bp, Homo sapiens
  misc_feature (26)..(26): n is a, c, g, or t
  misc_feature (58)..(58): n is a, c, g, or t
gtaatgggtgatcgttacgtcgtgcntaggcagttgatatcgcccgcgccacgctttngtatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaa

SEQ ID NO: 464367 - DNA, 382 bp, Homo sapiens
  misc_feature (12)..(12): n is a, c, g, or t
  misc_feature (34)..(34): n is a, c, g, or t
  misc_feature (43)..(43): n is a, c, g, or t
ttttccggagtnctctccagaaccagggaacganaaaaagaantatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaa

SEQ ID NO: 464368 - DNA, 488 bp, Homo sapiens
aagccatcacagtaaacacttaatattcccagtcattagacaaaatacgacaaacttcaaagaaacaagttctcctctctgcacacagccatcttggcagtggcagttggtttcccagtctctcatgaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaa

SEQ ID NO: 464369 - DNA, 643 bp, Homo sapiens
tttgtttacctactcaagcctcagcaatggcggacacccctcccccagccagactgcctcgcagagcaatctcagactgctgtgctagcactagtctgttacagcttcccttcactaggaaagggaaatccccagaccccttgcacttccagggccagtcacttgccatttctcataacagcgtcagagagaaagaactgactgaaacgtttgagatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaa

SEQ ID NO: 464370 - DNA, 299 bp, Homo sapiens
gcggccgcctactactactactgctcgaattcaagcttctaacgatgtacggggacatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaa

SEQ ID NO: 464371 - DNA, 519 bp, Homo sapiens
  misc_feature (26)..(26): n is a, c, g, or t
  misc_feature (58)..(58): n is a, c, g, or t
gtaatgggtgatcgttacgtcgtgcntaggcagttgatatcgcccgcgccacgctttngtatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaaaaacaaaaaaaaatggtctcgttggactcac

SEQ ID NO: 464372 - DNA, 1678 bp, Homo sapiens
ctgtccttatgtggtaccctcactgggtggagaccatgtacatcatgtcggtctccctcctgggaaatctgatagaaaattcctgccagacgtgtttggagttttttccttctggtgggttcgtggtcttgctggcttcaagagtgaagctgcaaaccttcccgctgagtgttacagctcttaaggggtcacgtctggagttgttcgttcctcctggcgggttcgtggtctcgctggctttaagagtgaagctccagaccttcgcgggccagcaggagtgcagggcctgccaagcccgcacccacccggaattcacgctggcctgcgagccccaaggaccacccaggacccagggccagtcagtgctgaccattcttccacctaaccagaccccaccgcttctcctcaccaccaccttcttccttcctcatagtgcaaatcagaggccctgcgagcactgggaagcagtgaagatggagtgaggcctgcagtgataaaatactttcaaaagccaggtctcatgaatcctcagcatagctgtaagggattgggagtgattatctccttgtacagatgaggagaccaaagtttcaggtcacacagcaggtaaataagtgatagtattaggacacctttctttctggtgtcaaatccatacctgctgcctttgctctggtttagattaggatttctcaaccttgacactattgaatccttgggttggagaattctttgctgtgggtggcgggggaaggtggggggctgtcctgtgcattggaggatgttcagcagcatccctggcctctccccactagattccagtagcacccacctcaccccactcccttgtaacaaaagaaaatatctccagacattgccatatgtcctgtggaaaggcaaaagaggagacgtatatatttgaatgtgggcagtggggattgagagcaactctatccaacttggattgctgtcatcagtgtgccccgtgggaaatctttagggagttcaccgctagggcagaaaaaaggtgaaatcgttgttttagatcatgtgcttagcaccatcatgttcctgtaagttccaggcggtttaactttgcctccttgtgccaaaaacgtctttgttttcatcaactgtgcttctgtttcttcattaggctgcattccggtcccagtttcaccttccctccgattttccctcgccggttgcatgttcatcatagctcctacacgcaggggtgctcccactaactatggaagcgggcgggagcatttcccctcatactaaagtctactttgggtctgctttgcaatttccttttggtctccctcctggagattcctgtgccacctgttaacacccttttgtgtttggctcatttctttcttcaaattttgctgcttttaatctttctttctaagcttagtggagtgtgtgtaaattaggagtgagcagacgatgaacaagggtccaaatgtctcttccttggggtaaagtgtattttgtaaaacagcccaagtctatttttcaagattagtctccccatgattcaggcctttccatgaacactggggtccttggttctccatggtgggctccttgggagtcagggctctgaggaggcagacactttgactgtgaacagtggagttttacacacctaaagttggcatgtcag

SEQ ID NO: 464373 - DNA, 2401 bp, Homo sapiens
  misc_feature (43)..(43): n is a, c, g, or t
  misc_feature (66)..(66): n is a, c, g, or t
  misc_feature (135)..(135): n is a, c, g, or t
  misc_feature (151)..(151): n is a, c, g, or t
  misc_feature (413)..(413): n is a, c, g, or t
ggtgggatgtggggctgcagatgctttctccttccaaggctcntgatccaaaactataaggtcccnagagtgttgagatgcacaagatgcaggtgtaaacccactcttgtgtctgactcctgaggaccggagctnccagtggggcctgggnctgcatgccaattccccgaactcagggccatgtcaagtacatggtgggtatcgctagaggtgtggtgaatgagcaaatacatgagcaaaaggaagaatgatgaatgatgctcatcacaccctcgggtgaggtggtgcctgcaatgctagacagaggtgcctggacgaggatgctggcagggccggtgtttgaagctgataatgttaaacctctctgcccaggtgccagcttggtgacctcaggcaaactgaaagaaagtctngaagagtttaactaagggacgaatatctacaccatgaggtgtggtaagcaccactcggagggtgtctttcaatccaggggaggatgtaaccaaccattctctacagcctgcttgggtgaatgtgccccagggcgagtcacttgtggaagggctgctgtatgtgctaagaaatacaacaatacagaatatccacagcaatacagaatatccacagcaaaacagaatatccacagcaaaacaacaatacagaatatccacagcaatacagaatatccacagcaatacagaatatccacagcaaaacaacaatacagaatacccacagcaatacagaatatccacagcaaaacaacaatacagaatatccacaacaatacagaatatccacagcaatatagaatacccacagcaatacagaatatccacagcaaaacaacaatacagaatacccacagcaatacagaatatccacaacaatacagaatatccacagcaatacagaatatccacagcaatacagaatatccacagcaaaacaacaatacagaatatccacagcaatacagaatatccacagcaatacagaatatccacagcaatacagaatacccacagcaatacagaatatccacagcaatacagaatacccacagcaatacgacaatgcagaatatccacagcaatgcagaatatgcacagcaaaacaacaatacagaatatccacaacaatacagaatatccacagcaatacagaatacccacagcaatacagaatatccacagcaaaacaacaatacagaatatccacagcaatacagaatacccacagcaatacagaatacccacagcaacacgacaacgcagaatatccacagcaatgcagaatatgcacagcaaaacaacaatacagaatatccacagcaatacaggaacaagtctaacttggctcatcctcttcggagtatttatcttattaccatgacaacttacttcataattttgttgccaaacacatgactaaaaaaataggacagggactttacttagtaaaattgaaaataaatcctcaaaagtacaaagtaaataataatccagtatccaaaagcattaaaaatgtaacttaaaaagttaatttagtggtgaatagatttttaaattcctaatattgttaaagcctttacaaatatcgaagatataagttctcaaaaaatacaaaatcaaaggttaacattaaacaatatttgcttgctcaaacgatattttctgggctttggaatacacccatgctttattttactttcaaaggattttttgaagtcttgctctttgtaaaacaatagaaccatccagaactgaagtaaaaacagaaattgctccttcactctctccacctcacacagctagtgttttgccttctcttcccccagagcaaccactcttaacagcaggcatatattcatacgaatagatagtctatatatatatatacaaaaaaataaatgtcatatatcttattttataacaataaaatcactttacagtcatagtaatgcataagactgcattcagctatatctcattccctttaatgtctgtgtggtacaacataatgtggatatacttaaattcttaaccatcctcttattgaccaatatgcaggttgttttcaatttatcattaatacaaagaaggttgcaaaggacgttttgtacatatgcctttagggcacatggcgtgatggataacaaaagtaaaagtgctgttcacatgatatgcacactcgatatttgataggcattactgcattgttctttaaatggtccatgaaatgctattcacaaatagttgctactctctgctgcacatcaacttctgacaagtctgtaaatgaatagcacaaaaatgaggttcctgttattgtctgttaggttcaacagtccctgaactcttcagaaaataaagaaattttaaaatctccctcaaacacc

SEQ ID NO: 464374 - DNA, 1472 bp, Homo sapiens
agcagcaagaatgagagcagagggggaagcaaaggtggcacattgattataacacacagctgaggtctcgatcacactagatgtctccagtcagtcgtgtggaaatcgatgtgcttcagaacagtctattggatgacctggctccaggatcagggaagtcagagcccagacctcggttcacggtgcttcctcagattctgggaatgctgcaggaagctgaacttcaggggcccagtgggttcaggccccagacaccagggtctttgcagtcccatcatgagtcttgttctgtcgcccaggctggagtacagtggtgtgatctcggctcactgcaacgtctgcctcccaggttcaagcgattctcccacctcagcctcctgaatagatgggattacaggcacccaccaccacgcccagataatatttgtatttttagtagagatggggtttcaacatattcaccaggctggccttgaactcctgacctaaggtgatccacctacctcggcctcccaaagttctgggactacaggagtgagccaccatgcccagcctatacttattccctgacttctcccaactagtatgtaaacttcaagctgacaaggaatttgtcttaaaacagtatctggcatgtaagaagcactcaattaatattcattcactgaatgaaagaagaaaggaaagagcatatgacaagaaaaacaacaacaacaacaacaaaaaggataagcaagacaatctacgtttataacagaagaattgaatctaggggtgctcgttaagaattgtgatcaagcttaaatttttcccagaaaaaaaaaagatgtttaaatagtacaagaaaatgaatacgacagattgcatcttgtaataagtaagttctaaagagagagagtgttccatgtctgaaaatgtctagctgatagcatcatgggcataatagtggatcttcatctaagtttattcagtctttacccaacttgtcctggatggccaagagactagcaaaggttggatgcaggtggaacatactctgactcagggatacttatttcatgattagacagcagtttcctaatcattgtccatcccttctccccatgcacacgattcagcccttagggttatctctggatacccatcacttgggttgctgggcactcttgtgtaaagagaaccagccctgagaaaagagaaatttccttcagcagtctacaccttcatagatgagggtagtagcaacaggagaaatctattttacagattaaaatcagaagaaaggagaaatttctgctaagacagaggagaacagtagactggctatcaacaagataaactatagaaaagcgatcactagcgtatgaaccatcccccaaggcactgtaggtcaaaacagatgatctaggaacctgcagatgaatccctctagaacaagaaaacaacattaataaaagtttatatttattgaa

SEQ ID NO: 464375 - DNA, 1527 bp, Homo sapiens
cacagtggtttgaagcgctgcaggcattgatgccgtttcttcataatgtcaatggtctttacaatttgtcaggcccctctgctgcaggtcttctggagtttgctggaggtccactccagaccctgtttgcctgggtatcaccagtggaggctgcagaacgcaaagattgctgcctattccttcctctggaagcttcatcccagaggggcacccaccagattccagctggagctctcctgtatgaggcagctggctgccaggaacgtttaagtctgctgaagctgcacccacagccgccccttcccagaggtgctctgtctcggggagatgggagttttatctataggcccctgactggggctgctgcctttctttcagagatgccctgctctaaagcaggacaagaaccaaaggagttgcaaactcagccaagatcaagccattggaaaattgtggttacaatggttcccataggatgcttgatattcttgccaatggatgcaagactccagggccattaagaataatgctgctgtcaacattcttgtataggcctttgtatggacatatgtatatattttttctcttaggtaatatacagaagttgaattgctgtacaatgttgagattttcaaagcttattgccattactaatactgtattaactggtctttcatctttggacttcagtttctgcatcttaaaaatgtggaaaatagaagtctctattacataaagttgtgaaatgtcatgccacgttattgctctattttttgtttctgctccaattatgcataggtgtctgagggcaagggttgaatgaggagaaaaagaaagaaacaagaagataatgaacttagctttaaagatgttggaccctttgattaagttggattgtttttccaagaagcgtactggaagaaacaacctttcttcctactgagtgtgattagaagcatggctctcctgctaacgactggcctccgtcttgtgaccagaaacagagctttagatgaaagctaaagccagttttggattgaagcaaaatactgtagaagacagagatggaagaaatctgtcttcagtaatattgcgccacttgatcaaggctttgcagacatcttccaagccagtgatatgtcttcattatttaagacagtttgagttttatttatcattatatgcaacagattcctgaacaatgcactcatgtggaatgacagcttctattcacttgctatctgaaaacatttcttaacacataattcccatttcctttttcccattattttgaagaaaaaagaactataatttcaaatcatagctcattgtctattcaagttcaagatcaaccattttctcaccagatactgtaatctcagttctttcaaagagatctcacatgtctgttactaaattttaattatttaccttgtttttcatatttttatatcaaaaaattcaataattgaatattttttgttaacactggtcatttcttgtctccccatctcattattcatggaa

SEQ ID NO: 464376 - DNA, 1699 bp, Homo sapiens
ccacctgctgtggtggattcgggcaggaccgaggccaggggcagtccgggctttgccccatcatcactcaggaggccaggtgtggtctcctctctgtgcggagcctcctcaccttgctctgggctcgtggccgtggctcttctctccatctggagccgcctcgcctccctgcgcactcgtggccatggctctcctctttgtgcggagccgcctcaccttgctgtgcgctcgtggccgtggctcttctctccatatggagtcgcctcacctccctgcgcactcgtggccgtggctctcctctctgtgtggagttgcttcaccttgctgtgtgctcgtggcctcctgtgacttatcagaagctccactgtgaaggagcagagaggcagtcatgccccctcctgggtatgatgctcctgaagcacgaggggctgctgccgatggccccagagccttgggcacatgggaggtggaccttcaggttgaagcccctcaagcccagaggcccgggaatggtgcaaggtgctcagccgagaactgttccccctgggaggactgtgcaggtgtccaccaggtgggcgtcaaaggcgaggggcggctggtgtgggagtgtggagggggccatgcaggagttgctcctggacggaatgaagagagcagcagaggagaggaagggggctgccaacaccgtgagaagctctcctttttcatgtgcgtgccttccagtgggaatgcaaaccgccacagcctcactggaagtccactgggcagcttcctatggaactgggcacactcttaccacacactccaacattcctgctctttggtattctccaaattaactgaaaacttctgtccacaccaaaacctgcacacggatgtttatagcagctttattcataattaccgaaactcagaagcagccaagatgcccctcagtcagcgaggggacgatggtgctagtcgtgtggcctctgagaagtcattaggtcatgagactggcgccctcaggacaggaacacaatgcaaagacgccctcaccagggacaggaacagcaatgcctcgaccgtgtcctgccagcctccagagctgccacagacaaacttctggggtttaagccaccagcctgtgaacaatggaaatggaaaagagatctttggctgccaggggttcagcggggaggcagtgagcaggccaagcaccgagggtttcgagggtggtgaaactgttccaagcgacagtagtcaccctggtgatgctgctgtaaacaaacctaccatgctgccagtcatagaaaagtctagcacctacggacatgagcatagaagtacacagtgcttgatgatgctctgcagtgagagtggagtcagcgtttcttcttgctattgagcttcgggataggcatctatcacttgcgctcacacagttccttccgttgaacatctgcaaggtgacacagatttgagggaccgtcacacttgattagagcccacttgggtgctcctggaacctggaacagacaaactccaagaggagattgaagattttccgcatcctgggactccaggccgaatcactttgtgtggcctcggagggaacacctatccaatgctgccaagaaataaacctttcagggaaaagggagtttgattgtaattcagtcgcaatttattctgttgtattttggccatttcatttgct

SEQ ID NO: 464377 - DNA, 1847 bp, Homo sapiens
ccacctgctgtggtggattcgggcaggaccgaggccaggggcagtccgggctttgccccatcatcactcaggaggccaggtgtggtctcctctctgtgcggagcctcctcaccttgctctgggctcgtggccgtggctcttctctccatctggagccgcctcgcctccctgcgcactcgtggccatggctctcctctttgtgcggagccgcctcaccttgctgtgcgctcgtggccgtggctcttctctccatatggagtcgcctcacctccctgcgcactcgtggccgtggctctcctctctgtgtggagttgcttcaccttgctgtgtgctcgtggcctcctgtgacttatcagaagctccactgtgaaggagcagagaggcagtcatgccccctcctgggtatgatgctcctgaagcacgaggggctgctgccgatggccccagagccttgggcacatgggaggtggaccttcaggttgaagcccctcaagcccagaggcccgggaatggtgcaaggtgctcagccgagaactgttccccctgggaggactgtgcaggtgtccaccaggtgggcgtcaaaggcgaggggcggctggtgtgggagtgtggagggggccatgcaggagttgctcctggacggaatgaagagagcagcagaggagaggaagggggctgccaacaccgtgagaagctctcctttttcatgtgcgtgccttccagtgggaatgcaaaccgccacagcctcactggaagtccactgggcagcttcctatggaactgggcacactcttaccacacactccaacattcctgctctttggtattctccaaattaactgaaaacttctgtccacaccaaaacctgcacacggatgtttatagcagctttattcataattaccgaaactcagaagcagccaagatgcccctcagtcagcgaggggacgatggtgctagtcgtgtggcctctgagaagtcattaggtcatgagactggcgccctcaggacaggaacacaatgcaaagacgccctcaccagggacaggaacagcaatgcctcgaccgtgtcctgccagcctccagagctgccacagacaaacttctggggtttaagccaccagcctgtgaacaatggaaatggaaaagagatctttggctgccaggggttcagcggggaggcagtgagcaggccaagcaccgagggtttcgagggtggtgaaactgttccaagcgacagtagtcaccctggtgatgctgctgtaaacaaacctaccatgctgccagtcatagaaaagtctagcacctacggacatgagcatagaagtacacagtgcttgatgatgccaaaggcgggttcttcaggaggtgtcctcctaggagctggcagctccatgcctgtcgttgacccttgacggccttccagagggacaagaggaggaggcgaaagacagtgacgtgtgtgatcctgactctgtgtaggctgaggctaagctctgcagtgagagtggagtcagcgtttcttcttgctattgagcttcgggataggcatctatcacttgcgctcacacagttccttccgttgaacatctgcaaggtgacacagatttgagggaccgtcacacttgattagagcccacttgggtgctcctggaacctggaacagacaaactccaagaggagattgaagattttccgcatcctgggactccaggccgaatcactttgtgtggcctcggagggaacacctatccaatgctgccaagaaataaacctttcagggaaaagggagtttgattgtaattcagtcgcaatttattctgttgtattttggccatttcatttgct

SEQ ID NO: 464378 - DNA, 1262 bp, Homo sapiens
gtcccgggccggcggcccccgccagccgccgccgccgccggccccgcctccgggcaccatgctgccctcgcaggaggcctccaagctctaccacgagcactacatgcggaactcgcgggccatcggcgtgctgtgggccatcttcaccatctgcttcgccatcatcaacgtggtggtcttcatccagccctactgggtgggcgacagcgtgagcacccccaagcctggctacttcggcctcttccactactgcgtgggcagcgggctggcgggccgcgagctcacctgccggggctccttcaccgacttcagcaccatcccgtccagcgccttcaaggcggccgccttcttcgtgctgctctccatggtgctgatcctcggctgcatcacctgcttttcgcttttcttcttctgcaacacggctacggtctacaagatctgcgcctggatgcagctcttggcaggtaggggagggggtggacggaactcccagaacaagcgccagggacggggctccttcctgccaggtccccttcctgaaggagtcggatagattctgcttctctgtgttaagacactcacctctttggctgacggaccctcagtgggtattggggagggggtacgctgcagagagacaccttagggcaggggacagagccttgggactgggtgggtgggtctgtatgcttgggtatgggtacgctgcatttattgctcggttagcattaagttagtgtctctaagggtctctgttggctgtcttgggggaaatatttatctgagtgaggggttactgtaggtatgatcaatttctgttatgttgaaaaaaagcatgaaatggtgaatcaagagatctggcttggacttttaatttgttgacactatcaacttgggtgtttcactttacttctctgaggctcggtttcctcatctgtaaaacaggggagaagattccaaaaggacaaatgaaagagtgttttgtaacctttaaaatgctgtgataagggggagaggctgtctattgtgcttatccagtgtttgagatcaacgtgatgaacatcctcacagttaaatcttagaggacatctgtgaacattttcttcgataaattcctgtaaattggcaagctcagtcaaaagaggtttaaacgtttcatttttctgtttttgagattaatccatgatttctataagttacatttgacctctgcattgcctttctttgctgctttaattatttcattccaagtgaatgaaaat

SEQ ID NO: 464379 - DNA, 1622 bp, Homo sapiens
tccctgacttccgggtcgcggtgcttgaagggagtgttccgtcgtttccgttgccggctgtttgcagtggggaaaccgaggcagctcctgctccccctagttcttccgctcctgtgaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagaggcatgggcatacttgggttaatcaatcttgtgtatttcagtgaaaattacactagtgaagctcatcagattctttcccgttcaaatcatccaaaattagggtattcttatgcaatagttggaatcaatcttacagagatggcttatagcttactgaagagtgaagctttgaagtttcatctctataaccttgttcctggtataccaacaatggaacactttcatcagttttactgttatcttgtctatgaatttgacaagttttggtttgaagaagaaccagaaagcattatgtatttcaatttgtatagagagaagtttcatgaaaagattaaaggacttttactggattgtaatgtagcacttactttaaaagtataaatcatccactgtatcttctatttctaccacattttgcacattcaacagaatttatatgttgtaataggaattatctgatcaattacactcttatatataatttcctacaaaaatatttcagaaattctatttaagaaagctagtggacaatcagtgtatgtttacaattgtttatacactgttctccaaaggtaccttatccttccaaagatcccctctgtagagtcatgcgaactacagtttggaacttgggacttagcccgttggtgtaaaagtataaatcaggtatttgtattaaattgattaaaatgtgaattggccaacttgcttccctccatttgcaactgcccgttgcctgaccagggtcccatgcaaagaaataaagttatatgttttcttccttattcttgaaagaaacatgctatttgaaggttgtgatttgtcctagtttgaattctttgctggtatgtagaaatctaggtatctagtcttttaaatattgattttattagccactttgccaaactcttattatgtatgccaattcttttggattttctgtgtacacattcatatcacttgtgagctataagatgccaaattataaacagga

SEQ ID NO: 464380 - DNA, 1102 bp, Homo sapiens
tccctgacttccgggtcgcggtgcttgaagggagtgttccgtcgtttccgttgccggctgtttgcagtggggaaaccgaggcagctcctgctccccctagttcttccgctcctgtgaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagaggcatgggcatacttgggttaatcaatcttgtgtaagtgaaagtaaactttcttttcttccctaaatgaaattacatttaatctctgatctagttacttctaataagaagtgatctagttgattcatactatctctgaattttaataactgcagtgctggaagtatttgctaatgtgttggcaacaatatgaagatattggaggccaggcacagtggctcacgcctgtaatcccagcactttgggaggctgaggccagaggatcacttgaagccagaagtttgagaccaatctgagcaatatagtgagaccctgtctctacaaaaataattagccaggcatggtggcatttgcctgtagtccagccacttgggaggctgaggcagaaggattgcctgagcccaggaattcaagtttacagtgagtcatgattgtgccacctccagcctgggtgacagagcaagaccctgtcttt

SEQ ID NO: 464381 - DNA, 766 bp, Homo sapiens
caggtcatgcatgactatgactggagcagacttggacctggactagaatcactacgactcattatgtatttcaatttgtatagagagaagtttcatgaaaagattaaaggacttttactggattgtaatgtagcacttactttaaaagtataaatcatccactgtatcttctatttctaccacattttgcacattcaacagaatttatatgttgtaataggaattatctgatcaattacactcttatatataatttcctacaaaaatatttcagaaattctatttaagaaagctagtggacaatcagtgtatgtttacaattgtttatacactgttctccaaaggtaccttatccttccaaagatcccctctgtagagtcatgcgaactacagtttggaacttgggacttagcccgttggtgtaaaagtataaatcaggtatttgtattaaattgattaaaatgtgaattggccaacttgcttccctccatttgcaactgcccgttgcctgaccagggtcccatgcaaagaaataaagttatatgttttcttccttattcttgaaagaaacatgctatttgaaggttgtgatttgtcctagtttgaattctttgctggtatgtagaaatctaggtatctagtcttttaaatattgattttattagccactttgccaaactcttattatgtatgccaattcttttggattttctgtgtacacattcatatcacttgtgagctataagatgccaaattataaacagga

SEQ ID NO: 464382 - DNA, 616 bp, Homo sapiens
tccctgacttccgggtcgcggtgcttgaagggagtgttccgtcgtttccgttgccggctgtttgcagtggggaaaccgaggcagctcctgctccccctagttcttccgctcctgtgaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggataggtaatgttattcaaaaagaaaaagtactaataaaagtttaacggagtgtttttctcaggactcacagtgacagatgtatttcttttgtatcctgacaagtcacttaaactgaatttcataagctctgaagtcccgctttgactccttcagctctaaaattgtatgaatttatagaaaaagtggttatttaattgcttatgtgtggaaagaattctctggctcctgaagtttatcggttattccttagattatagttgcaacctattttctggtgaaaaatttctatacttacataatccctttgaaattttcactcacatggccactcaatacctggccactcaata

SEQ ID NO: 464383 - DNA, 360 bp, Homo sapiens
attggccatttgatcatcaattaatagcggtatatattacacctgccattgtttttaaatgcctaattaaactgtcaaaacagacacaatgaaatgatagatacataatttgagatttgatcagttgtataaactttttaaattttaaaattcagtttaaggtcattaagcttgtcttgtatgtttccctcctccaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggataggtaatgttattc

SEQ ID NO: 464384 - DNA, 1701 bp, Homo sapiens
agagccctggggtgctcaggcgccgctacgcgtgcatcccctctgctcggcagttctgcgcttttgtcctaatgagcgcggactagatggcttgattttcaagataatgatcaacccagctgtgctatgcgctctttctgcactgacctgcgggtacttcgaacttcgacagtccctcctcaggccctagtccagaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagaggcatgggcatacttgggttaatcaatcttgtgtatttcagtgaaaattacactagtgaagctcatcagattctttcccgttcaaatcatccaaaattagggtattcttatgcaatagttggaatcaatcttacagagatggcttatagcttactgaagagtgaagctttgaagtttcatctctataaccttgttcctggtataccaacaatggaacactttcatcagttttactgttatcttgtctatgaatttgacaagttttggtttgaagaagaaccagaaagcattatgtatttcaatttgtatagagagaagtttcatgaaaagattaaaggacttttactggattgtaatgtagcacttactttaaaagtataaatcatccactgtatcttctatttctaccacattttgcacattcaacagaatttatatgttgtaataggaattatctgatcaattacactcttatatataatttcctacaaaaatatttcagaaattctatttaagaaagctagtggacaatcagtgtatgtttacaattgtttatacactgttctccaaaggtaccttatccttccaaagatcccctctgtagagtcatgcgaactacagtttggaacttgggacttagcccgttggtgtaaaagtataaatcaggtatttgtattaaattgattaaaatgtgaattggccaacttgcttccctccatttgcaactgcccgttgcctgaccagggtcccatgcaaagaaataaagttatatgttttcttccttattcttgaaagaaacatgctatttgaaggttgtgatttgtcctagtttgaattctttgctggtatgtagaaatctaggtatctagtcttttaaatattgattttattagccactttgccaaactcttattatgtatgccaattcttttggattttctgtgtacacattcatatcacttgtgagctataagatgccaaattataaacagga

SEQ ID NO: 464385 - DNA, 410 bp, Homo sapiens
gttccgtcgtttccgttgccggctgtttgcagtggggaaaccgaggcagctcctgctccccctagttcttccgctcctgtgaggtggctgctgtttcttttcctcttgccccggatgcctcggtgcggctgcactgagagcgcgcgggctcgcgagccccgcggggttctgcgggaacccgggggcgcctgggccggcgggtctttgtgcgagccctgccctcccattcgcgggcggcgcgcgaggggggtcggcgcagagacgcccagagccctggggtgctcaggcgccgctacgcgtgcatcccctctgctcggcagttctgcgcttttgtcctaatgagcgcggactagatggcttgattttcaagataatgatcaacccagctgtgctatgcgctctttctgcac

SEQ ID NO: 464386 - DNA, 1575 bp, Homo sapiens
gattcctcacaatcccatgaggcaaaagcaaaagtctcttcctgtgttattaagtgaaaatggctgattataaaaaggccctgggtcaggaggttgccgattccaggaagaatcagaccttatccctgcccttgagtctcaagaagaggaaaggaaaacaaataagcatagtacagtgtgaaaagtgggactgtggtcaaatttcagtctgcaaactcagatcatgaaagatagtgtggcttccactttggtctcttatatcacctactgggggaagccagctgccatgttgtgaggacactcaagaagctctgtggagaggctcttttgaaggagaaccaatgcctcccaccaacagccagcatcaacttgggacatgtgagtgaaccaattggaagtggatcctccagccaagtcaagccttcagatgactgaagccccagcctcatgagagatagcaggctaaaactgcccagctaagctgctcctgaaatcctgaccccccaaattataaaagacaataaattattattgttgttttaagccactacatgttggggtgattcattatgcagcaacagataataaatacatcacccttgtattcattactgacgtttattgggagcatagtgtgtgatttttcatttaacccttccagtaatgctggcttggcactttgcacttacaaagccttatacatccctaattccatggaatcacacctggcagatggtagtggtgagaagtgggtggctactggatacaggaatgaggcagatcaatatgaactgatgtggaaggatctgagtcatactgttaaaccgacaaatcaagatgtaaaggacaatgtgttaggccacattttcccagaagcagaccttgagaggaaaggaatgaaaacagtttatcccaggaagcactgggaagagagagggacagaagacagggagagaaggaggccagcaaaggtgtgttattgagcaggttactgctttttaaaacttgggctcaatccctgcggggagcgctgggaggtggtgtaggatgtgtctccaagttgtcccaataggaaaggcaggagaacggtgcaattataccaactcccacgaatcgctggttgagattggctcttaaaggggagcaccaacttcctggcacttcagactgccttggtgcaatgaatctcaggcactggggtttgaagcagggttggtgttcatggaaatggtgactgggagggggaccttgctggtgtctgttatgcagtgcttatggtgcactgccatttccatcttcaccaaggaattgatctttatatggatatagagaataactctgaagggacaaataacattctggtgttgcctctggggagaggaagtagaatatttagggtcaagatggttgagacactcttcactgtataactttctgtatacttttattttttttactgtgtgttttaatttatgaaattaaaaaataatgttgggaattttactttcattcatggaggagtgacctttgaaagaagagaggcacctgagggcatgagggaagccccaggtcccc

SEQ ID NO: 464387 - DNA, 3539 bp, Homo sapiens
gcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggctttgaagggcgccagttcccagccgcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtggcagaggagagggaagggtcgcgcctggtgggggcctgagagccaccgggctgcggtgcgcgagtgtggacaccgccccgccttctgcgtctacagccctgggttctgggacctttggaaaccgctttggacgaagctgagcatctctttccccacgctgacctcccccatagactccggatgggagtaaatgaggctcctgggaaatccagaaactctagagaagcttgtttgccaaaccttgctttgggcggtggagacagaatatcatgtcccagatcagcgtgtggtgactgtggaggcatttacacacagcacactccagctctgccactgggccggctgaggtggctgcggtacacggcgcccatcctgagccccaggttcctcacatgtcaacagcatgaaaagtgcctctaagacatccacaggtgtgcagtgttaaagcaggcagcgcctcagcttggttagctcccttaaggactgcggctcccttaggacaaggctctgtccctcagagcactgagtgcgatctcatgctggcatcttagagacattgtattcaccagccggtgaaagagtacaggcaaaaaacgtggtctcggactttccggtgatgcttaagaacatagttgcagtttttgttctgattctttgtgcatctcgcgctaatgaaggattctgccatgattgccacctctggagacgtcacagccagcacagccatgaccagggatgaacttggccattgtccagcagcaccatgggaggaccagctgctatgtcagcacagcagtgtcagcagcttcgtcaaacacaaacaccaccacctctctggatcagaagcacatggaaagcccaccttgcaagaagacccagctattccaaaagtacccatatccctcacagagcttggtgtgccaaagggcacaaggggttttagaccctggaccccggacatgttccaagactcttttactttatgtcagacatgcaagccctgcctcggcttcttcccaacactcagctttttcccaacacacgtattcactaactcaggcctcagcacaccttactgggtaggtgctaccatctgcccattttatagatgaggaaataaaggcccagagatgataagaaacttgcccagggtcacatagtcaagaagtaagtgactgtatcagtcatctatgggtttgtaacaaattaccccaggatgtagtggcttgaaacaatatttaatatctcacaacttctgtaggtcacaaatgctggcagggcttaactgggtcttctgcttccaagtctctgtaaactcagataaacttctaagccccctgctgactgaatggactccttgtgatcaagaggaccccagaaaaaccttaaaactaaactcccagccatagtgggatgtgaggtcagacacacctcattctaccccctcccttttgtggtttagacacaactgaccgacattaatgttaacacagagatcttaagactggcaaatagactctctgtagcagtaagataccagattgtaaacaggacccaaggccatgccaggcaagggttacatcacacatccctaacctttcttctaacggccaagggtatttttctctagcaactaaacaagcactggcctcgagatacgttaaacaattccagctcatccagctcagagacgttaaccaaccgaccccattccaccagccataactgcagctttgacttgaacttactgaaatctctttgtatactacaaagagcctgtagtacaaagcgattgattccagtaactttctcctgaccatgaactggtcctggctggctgtacacttggacaccttcatgtcctgaaaagaccttttgacatatagggtctaactgtagtacatttaaatgttaagtctccatcccaaagtgaacatgggtggtatgttacacgaacatttgtcccatacacatgtgccaggaccatcctgaatattcatagctcctcctgtcacctgttgaatatgcatgtttagccaaccagttcggcataaagctcctgtcccagcttctcttcctccatggtgtttctctctggtcttggctggaggctgtgcttcccaggctgcaggatggccaccttgcaggctgaaacctttacaagaaataaagtctcctctgttttctaaatgtattaattgtggttgatatgatacctgatcttgaattgtagctcccatcattcccatgtattgtgggcgggactttgtgggaggtaattgaatcatgggggtggtgatttctcacactggtctcatggtagtgaataagtcttacaagatctgatggttttataagtcggagttcccctgaacaagctgtcttgcctgccaccatgtaagacgtgactttgctccccattcaccttccgtcatgattgtgaggcctctccagtcatgtggaactgtgggtcaattaaacctctttcctttataaattagccagtctcaggtatgtctgtattagcagcatgagaacagactaatacagtgcttttgtatttttaaagttaacatctctcaagaagtgggttgactcaagcctcaactagggcaggatctgtttccaagctcatgtatggggttgttggctggattagggtccaaggcagttgctggactaagggcctcagttccttgcttttccaatgctgcacttaattcattgcagtaaggcaggtgtgaggactttacccagcaggcccaaggccactctccctaaaaaggcctgaatgcaagactggcccttagttggcctctgggaacctggattttgggagtgttcccaacatcccaacgggtaagagtggttcaatgtgcctaaactgtttatgcaaacaatacactgagtgcctgctttccctgcgggagtctggaatgttggaggtgccagacaggtgcccacatgacccctgtaagctccctgagcactgagtctttaatgagcttccctgaaagacaacactttgcatgtgtaatcacaactcactgggtcaatcaagtctgtcctgtttgattcctctgggagaggactctcggaagcctgcacctgtttttttctagatgttaccccatgtgcctttccctttgctgcagtcacaagccttttgtgtaatacatcatagcagagtaggactaggtgctgagtcctgggagtcttcaccaaacccac

SEQ ID NO: 464388 - DNA, 1232 bp, Homo sapiens
gtacccctcggctctaccttgtctaggatacagtaggaagactgtatagttcaaagcaatatttcaaagacctctaacaggagtgaaaattgcataattcacttgtatgtccttatccatcccttttctaaataaaaatgctctactacctggtccagggtctttgattccatagcatagtgggaagcaggcactaaactgctaaattctaacaccatctgtatgacctaaatcctaagagatatattgtttctgctgccaatgccagaatcaacctcagctgccaacgccagaatcaacctcagctgccaaatgctagactgaaaaaagaatgtaaacagcttgatggaggggaggatcctggtgcacctgtggttttgacagcttttgctgctgcttgaggaggaaacaggttgcctgtttgttcttcaagagcacttctggcatccaggtattatgcaggcatgcactgccagctgtgaaagatgccgcttccttgtcacttcagagaatgatgcttctacagaagatccctcttgctatttcattcagggagctcgggagaggaagacaaaaagaatcaaatgcaaagcacagatcattgaaagggccagggtctgaagtgagacaactcgtgtcacagtgttttcaaacttgagaatgaagagaagaaaggaaatttggtttgatgttatcagttttgatttgctaacccaaaaggtccagaataaagaacaaatcattataaattcctggcattgcaatcattgtggaaaatgctgatttggttctattaactcactaattcaattaaaaggagactagcaaaaatcatcttaggagagattctgaactctttacttaaaaactactgtataacctcagggttttgctgaagtgggtattttccattttaaattatcttaattctgacaagtaaatgtctttaggatttatatacttacaagctttcaaaggaaaaatctgaaatgttgattaattgcaaagatgatatcagaaactttttgttaaagtagccaactatttttgtggatttattgctttttacttatataacaatactattcatacataccatgcaaattacatatacgtattctgtcactcacagacatagaatacagtgctagaaggaatttcaagataaatccagacatctaggataccctaatattgcccaagttgcctaattattaactcaggtcccgtaa

SEQ ID NO: 464389 - DNA, 1816 bp, Homo sapiens
ttgtttattataattgtttatcataattttaaacaatttattatgatgcttgtctcttccaaccttggggaacaggaaagcacaaggagctttctggttctgacctcctggaagcaggatcccctgaacacgggcatgcccacgcatatgccccccattgacaggcatagcggcttgagtcagtcaaatatttcattcagaaccgacaggttacaatctacctattggcatcctgctggtatcacatgtgacacacttgtgatagctgctgcaagctggacatgttcaagatgtgcatctttggaaaggcatttaccaaagactgttaaacaactttacacttatgaaacagggcttgctttaagcccagaacaaaaaagtttgagcaatgtcagcagcactgacagcacctttggacatgaagaacaaggcagtaacaaagaataagcacacaacccaccaaataaaactcatttatttaatcaaaaatatactattagtactttacacaataaaaaaattttaatattaatatgacttaaagatacgttaattcaatccaatcattcaaatttgtttcctggtttttaaacgccatagccaccaagcattagttataggaagactgtatagttcaaagcaatatttcaaagacctctaacaggagtgaaaattgcataattcacttgtatgtccttatccatcccttttctaaataaaaatgctctactacctggtccagggtctttgattccatagcatagtgggaagcaggcactaaactgctaaattctaacaccatctgtatgacctaaatcctaagagatatattgtttctgctgccaatgccagaatcaacctcagctgccaacgccagaatcaacctcagctgccaaatgctagactgaaaaaagaatgtaaacagcttgatggaggggaggatcctggtgcacctgtggttttgacagcttttgctgctgcttgaggaggaaacaggttgcctgtttgttcttcaagagcacttctggcatccaggtattatgcaggcatgcactgccagctgtgaaagatgccgcttccttgtcacttcagagaatgatgcttctacagaagatccctcttgctatttcattcagggagctcgggagaggaagacaaaaagaatcaaatgcaaagcacagatcattgaaagggccagggtctgaagtgagacaactcgtgtcacagtgttttcaaacttgagaatgaagagaagaaaggaaatttggtttgatgttatcagttttgatttgctaacccaaaaggtccagaataaagaacaaatcattataaattcctggcattgcaatcattgtggaaaatgctgatttggttctattaactcactaattcaattaaaaggagactagcaaaaatcatcttaggagagattctgaactctttacttaaaaactactgtataacctcagggttttgctgaagtgggtattttccattttaaattatcttaattctgacaagtaaatgtctttaggatttatatacttacaagctttcaaaggaaaaatctgaaatgttgattaattgcaaagatgatatcagaaactttttgttaaagtagccaactatttttgtggatttattgctttttacttatataacaatactattcatacataccatgcaaattacatatacgtattctgtcactcacagacatagaatacagtgctagaaggaatttcaagataaatccagacatctaggataccctaatattgcccaagttgcctaattattaactcaggtcccgtaa

SEQ ID NO: 464390 - DNA, 785 bp, Homo sapiens
attctggtcacagaggccagagtagactatcagtgtaatggcccttcccctttgatgatagcagcttttttcgggggagcaggggtggccaaacttcctagccttattttatcttcctttctagttctccccagaggctgctgggtccacctctccctctgccagacagacaggctcagacatgcaagaacggaagggggtgtgggggttggtgggaggattaagttggggaaagccagtcttgtctttgtagattaccagaactgacacacgtacacacacgtacactcactcactcactcactcatctattcatctatttttggcctaagtgcctttggacacttcttcggaaaagcacatgaactcttcggagtctcctgttccacttggtaaatttcctatagccacgcactgaaagtccctgctgccctccttcctctgagcttgtggggcccacagatcccctgctccacttcctgcttcatttcagctgatggtgagtccagggcaggcttgtaggaagggcgggctaggcgtggggaactgcagcacccaccccaccccccgccccagtgcttgttgccccagcctctgtctccctcgctgtgcccttcccttaagccccactcttggcctccccaaagacagagtttgttctgtttttattgataggatgacactccctcgttctaataccatctgaatgcctgagcaattacatcttacaacctcatgaaaaacacagcagcttgtcacgatgaatgatgttaccgtgaataatg

SEQ ID NO: 464391 - DNA, 1959 bp, Homo sapiens
tccatctggttcacactgatgtccatgatcattgagttcattttttatatcaactatgtgacacttcctatagtttccagttcctgtgaactgccatgtgtttgtctcctgtcatggtaacatttgcattcagggagaggcctctgctctctgcagaacagtgtgaaatcacctcatttttgccttcaatgaaggttgtctcttgctggtcaccaccacttcctcaaatgactaatgccactcttgctcacagtgctaaggcgctaaggagttttcagagggctagagtgattctgcatcctctggggttctcaggaaacgaggccacagggccatctgtgcatgaattctccggctacattccacaagaacaaattctggtcacagaggccagagtagactatcagtgtaatggcccttcccctttgatgatagcagcttttttcgggggagcaggggtggccaaacttcctagccttattttatcttcctttctagttctccccagaggctgctgggtccacctctccctctgccagacagacaggctcagacatgcaagaacggaagggggtgtgggggttggtgggaggattaagttggggaaagccagtcttgtctttgtagattaccagaactgacacacgtacacacacgtacactcactcactcactcactcatctattcatctatttttggcctaagtgcctttggacacttcttcggaaaagcacatgaactcttcggagtctcctgttccacttggtaaatttcctatagccacgcactgaaagtccctgctgccctccttcctctgagcttgtggggcccacagatcccctgctccacttcctgcttcatttcagctgatggatgacactccctcgttctaataccatctgaatgcctgagcaattacatcttacaacctcatgaaaaacacagcagcttgtcacgatgaatgatgttaccgtgaataatgcagttttgagttcaaactccttcttattccaagaatgagtaaatatccctattccctcccctccccattgcatttgggtttgacatgacatgaatcattgtggttttactcctgggtagaattgtttttctgtattgcattgccaattgatggaaggacaaaaaaaggaaacttaccaatgagcagtttcagatgaacttaaattctcagaaatcttgaagaatgaatgaactataactttctgaagttgcaaaaatgttcaagtcggaagtgacccatgggaagcaacctggtccttaattaggactggaaagaaaacggaggcccagcgagggaacagtggcttccccaaggtcacactgcaagtgagtggtggcactagtcacccaggagtcctcctgactccatggtatcctgaccccagaccagcagccttatttgtggttaaagaacgtggaaaaacagcttatgtttgaattttaaaatcatgccagtactaaagatctgcattccatgaatattgagctttgctgtgtgcgggttgctacgaattttgtaactattttctctaagagctctcagtattttacatatacaattccattctttattgtccagggaaaaagttgcatttactgagcagtaagagggtgatttgaagtccctggggtcccccacccttgtctttctatgtgagattgtattgcagggctcacatttattctctcagcagctcattgcacagacagtgtatttattgagcacctactgtgtgccaggagctatgtggtaagctaagcagacaaaaactcctgctctcacaagaagaaagaataaacaagcagacaattgcacctataatgtcagcctgaataccattttgtggcacacgaaaattatatgaaattcaagtttcaatgtccacaaataaagttttataggaacatagcatgctcactcatttaggtattgttac

SEQ ID NO: 464392 - DNA, 1173 bp, Homo sapiens
ggaatcatggctcctggtcctgctcaatccgtccccagggtcacacaccaaattatggttcctggtcctgctcaatccttccccagggtcacacaccggaattatcactcctggtcctgctcactcctggtcctgctcaatcccttcccagcgtcacacactggaattgtggctcctggtcctgctcaatcccttcccagtgtcacatacgggaatcatggctcctggtcctgctcaatccctccccagggtcacacaccaaattatggctcctggtcctgctcagtccttccccagggtcacacactggaatcatggctcctggtcctggctcaatccctccccaggaccacacagcagaattcttacaggggccgtctttgttggggtgtataacagagtaccatagaccggatagttataaagaacagaaacatatttctcacagttctggatggtggaagtctgagagcaggatgccagcgttgctgggggctggccagggagagttcttgtcctcctaccctgcaatccctggagatgcgctccccccaaccgcagcccaaagtgccttttcatggggctgtaaggcagctgtcacgaggaaaatccacctggatggacagcagcagagggaggaggaggcaggacagaccagaagagagacaatgaggttctgaacctagatgttggccaagggagcagaggagggcaggtcaggaggccctcgccctgcaatcacccttcctgggagccttcacttcacctgtgatctcaagacctctccctactgcctgactcgcgccgagcttatggaacatcttcccttgagggtcgcagtccattcgatgagcccttgtcacaggtcctgcttctgtggggagctcaagcgcggacacccttggaacactccccaagtctcttccttcccatccagcaccacttccctaagtcacagctgcaccacctctcatctggactgctcacagcaggtggagtcaggatcaaaatagccaaagaaaaagtaagaatccgtatacaggaaacaaatatgtgatgatgaccggagcagctcagaatcagaacttgagcaagacctgggctgctttgattttctgaaggtctcaaaatattaggggcaaaaaagaaaataaaaaaagaaaaaaaagaagg

SEQ ID NO: 464393 - DNA, 1064 bp, Homo sapiens
gaatggggcatcttccatcacccaggtgcccagacacatggacaatgggtagaggcacccctccgagcccttggacaaggcctgagtatcctttcccgtccgcatcctgcactcagtatggttccctgcaccaagttgcgtccatgtcccataggctgaccctgggatgtgcttgtctaatccagcaggaaaagcccacagggctaaagggaatgcagaagcctaaatacaaagcaagtgcccctgccactcataactgccacatccccatagaaacattcactttcattagctggagaggagtttctcttacttcattccttgaaccactgtttatggagcacttccaattaccagacacaggtgacaaaaagaaaaaggaacactcaacatttaatttgactcacagttcatggtcttgaatgcatggcttcggatggcaaggcaatgcgttccgtgcctaagcaaagcacctagctctcaggaactgagaccactagctgagtgctctgtgactgttgggacttgagacccttcttatctcccccaagactcagtgggatggggctgctgttccggagctgactccaacatgccagccttttggaaatttgcctggaggctgaactgaaggtaggtccctcttccctccccccatcatttatttctttaacttaaaaacacttttttgggggatctcatatgttacaatctattaaatacttccttcctctcttcttccctgggtggagtaaatgtatgtgggaaagagaattctagagcaggagtaaggaaccctggatttgctaagacgtctggatctacagcaggcctgaggaaccctcgatgtacccaggactaaaggtccctggatgtgcatttgaattaaggaaacttgtctttgcacggttctcgtggtttacatggcctcttttgaacactccatttcttcttgtgtaaatggcacagcatgcccatcctgcccaactcactgggttacttggcacaagagaaccataaaagtgcttcgaaaaatatgaggcctaatgcaatagaggatggga

SEQ ID NO: 464394 - DNA, 2663 bp, Homo sapiens
acacatctacaaccatctgatctttgacaaagctgacaaaaacaagcaattgggaaatgatctcctattcagacatggtcatgggcaaaggcttcatgactaaaacacttaaagcaatggcaacaaaagccaaaattgacaaatgggatctaattaaactaaagagcttctgcacagcaaaagaaactatcagcaaagtgaacaggcaacccacagaatgggagaaaagttttgcaatctattcatttgacaaagggctaataatcagaatctacaaggaacttaaagaaatttacaagaagaaaacaaacaaccccatcaaaaaggacaaggatgtagttggaaaccatcattctcagcaaactaacacaagaacagagaaccaaacaccactgcaagttctcactcttaagtgggagttgaacaatgagaacacatggacacagggaggggaacatcacaccctggggcctgtgggggttggtgggctaggggagggatggtattaggagaaatacctaatatattttcatactgtttcctgatttataatcaattttattaaaaatatattttatggatctaggctttatgattgtattaactgaagagttcagatacaccaataagaaaagacaataaaataaacgaaaagaatataaaaagataactcacaaaagaggaattacaaaggaaaaggaatcaagttttaaaaaatatgagacttttttttacttaatagaggagaatatttattataattgacaatactttttactggaagaattcatagatgctggtatactcagatattggttttgacaataacaattagaacaactgttttataaacaacttggtactctgcatcaaaatttatgaaaaatgtcatacttttgtcagtgattcattccacttctgggactctatgctacaaatataaggtgggagatatattgaaagactatttgaattatatactttatttatattagtgaaaatgctaaaagtaccagaatatccaacagtaagggaatgattacataaattatgaagcatccactgaaaggaatagtataaaaggtgtcaaaatgaatgtcaatgaagactataaacatgggaaaatgttaatttaaaatatattttaagagctcaatatgacaggtttagtgctaccacaaaaatctaagaagaaaaatgtgcttataaaacaaaattttgaaacaaatgataaaaaatgttaaagcaattttgcaggtttggggatgatggtttttgatgttttttttctttatgttctaattttccttattcatgcttatttgtaatacgaaaattttaagtgtgtgaatacttacagggcattcactgtgtgtcgggcactatgctaggccttggaaacatagaggtaagaaagacagctatggcggctaccctcacagaacacaggatcaccaggatttggttacttggaatcagccttgactcatctctcttccacactcaaatctaatccattaggaaataccactggctttgctttcaaaataatatctaaaacccgatcattctccactatcttcattgtaacatcctagtataaatcaccatcatctccttcctggttactagaacagccttgtggtagaataatgcccccctcacccccccgaaagatgtctgtgtcctaatactcagaacctgtgactatgttacctgataggactttgcaggccttttattaagagtgtttgcaacatgtctcctatgccgtgggtgtcagtcagtgtcacaatgcaagctttgttctgaaaaagaatctcatagattttataggctctagaaggagagtgacattccaattttctcccaattctattggaaggtcaatcttaaatgctgtataggaggatctcattgagaagatatcatttgagcaaagatgtaaagcaagggagggaatgagtcagtggctacatagcgagagtgtcctaggcagaggaaacagcttctacaaaagccctgaagcaagagaatgtttgaagtgttcaagaataaacaggagatgcagaatgaatggaattgagagtgagtgaggcagtcggatacaagagagactaatatggggcagcactgaagactgctgacagcagccacatgagtgagctcagagtggacacaacagccccttcagaggctgcagggatggcagacagcctgactgcaatgtcgtgaaagatgctgaggcagaaccatgcagcaaagtcattcccagattcctgactctcagaaaatgtgtgagataataaatgctattattttaagctgctaaattttggggcaatttactacttagcagtagatgcctaacacaagattaataatatttatcataaaatgatatatacaccttttaaagaagttaagcacagttcagataagaattttaagatttacacttaatgtatcatccagtaactatcatttttaacattagtgttactttagagaagtctgaacttgccctttttttcatctttatgcctgaggaaatttttctttatcatcaaagaactctgagaattgatgggcactgtgttagagcaagtgggaagtatagacacagcttcccatgttaagcacgagcaagaagaaaataattt

SEQ ID NO: 464395 - DNA, 1259 bp, Homo sapiens
  misc_feature (1)..(2): n is a, c, g, or t
  misc_feature (5)..(5): n is a, c, g, or t
  misc_feature (7)..(7): n is a, c, g, or t
  misc_feature (10)..(10): n is a, c, g, or t
  misc_feature (12)..(13): n is a, c, g, or t
  misc_feature (15)..(15): n is a, c, g, or t
nnttntnttnannanagtggtgccggggaggacagtgtgtgaaatatggtgatgaaggccccaagcccacccatggccactggtcggactggtcttcttggtccccatgctccaggacctgcggagggggagtatctcataggagtcgcctctgcaccaaccccaattccacattctctcaaatgtgctatcctgggaaagtgtggtcctcctcaatcagcccctccctgtgcagggccatcgcatggagggaagttctgtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaagatcaggacttatgcaaactctactgtatcgcagaaggatttgatttcttcttttctttgtcaaataaagtcaaagatgggactccatgctcggaggatagccgtaatgtttgtatagatgggatatgtgagagagttggatgtgacaatgtccttggatctgatgctgttgaagacgtctgtggggtgtgtaacgggaataactcagcctgcacgattcacaggggtctctacaccaagcaccaccacaccaaccagtattatcacatggtcaccattccttctggagcccggagtatccgcatctatgaaatgaacgtctctacctcctacatttctgtgcgcaatgccctcagaaggtactacctgaatgggcactggaccgtggactggcccggccggtacaaattttcgggcactactttcgactacagacggtcctataatgagcccgagaacttaatcgctactggaccaaccaacgagacactgattgtggagctgctgtttcagggaaggaacccgggtgttgcctgggaatactccatgcctcgcttggggaccgagaagcagccccctgcccagcccagctacacttgggccatcgtgcgctctgagtgctccgtgtcctgcggaggggaatttaagggtctacgaggggcagttatggaattcatgaatgggaagaagacagctggaaaatttcccccacctcttgcttcattccagaaacattactttgcatcaaaagaggacggataaatctttttgatttaaagagatctcatttccttatctcttacaatgggcccatctctctgtaggaaataaggttttcacacagccaggta

SEQ ID NO: 464396 - DNA, 1198 bp, Homo sapiens
gttgagtcatacatcaacctctagtaaaaagtggcatgctctcagtcaaagggcacctgagatgatatgcctctgtgcactctagccttagaaatatgcttatctcctgcaggcagagcatgctggaagtgccagggagttaaggttaccaggaacagccctcaactaataatgaggaaaagcttgtggataaatatccaagccccctgccttcagaccttgaccattatgcgcttcccaagctgtggctgctgcatttcacattttctttcaaaattgggcaaggaattactaaaagatgctccagtagatcatctgggtaccaaacatatttctttctgtacccagtgtagaatagcaaccctacttttttatgatgctctggtgactcccatagacttgattatggtcagagtgtcatacaaatctaggctatacacagacatgtttccaagctaaagtgataagatgtctaaaagaaatatttcttagtctgtgttgaattaatgctgcagaaggtcatgggtgagtgaattactttcagaagggaggaagcaatagcaatagtgagcaaactgtgtatgaggagaccctatgaagcaagggcattctgtattgaatattgcaactcaaggaccaattcaaggttccttcttgggaacttttatagagagacacagaccataaaagaagggtacagaaattaagatgttgagagaaacaatactaccatgccagtttacatgcaaagagctacttctgtcttttggttcagatgggaactatgggaatgaaagctgctagtgttttgtggaatcttttccagaatatttttattgtttttctcctatgctgattatgaaatcaatataggcttatctcagaaaaatcagaatatgtagaaaagcaaaaacaactccaacaaaatcacaaaaaattttctccattcagagatagccattattagcaacttgtctatccaatcatatcctttttttaattaaaaaagttctatataataggattttgtaatctgtttttttcactaaatactgtcatctcaatagagcttatttttacatgattttgaaatatgcctgcatggtattcttctataggaatgtattgtaatttatttaattagtcctctaagggatgggcatttatatcatttgaaacttccattattataactttg

SEQ ID NO: 464397 - DNA, 730 bp, Homo sapiens
ttatgtacataaggtatttggcatggtgcaaggaacattaccactctcgcattttactcagtccctggagctccctgtgtccgtctcagtcatagcatttggcatttggtttctcaaccgttggtttcctttcctgcttctctcacttgatggtgaattaattggggattgtaaattcttcagcactgattattatgctgggaacgtagaaggcatttcttatactggttttacaaatgagaagctgaagctgagagtgaagatacggtttgcccaagttattacatacaggaagatagcagaccagaaattcagatcaggtcgagtcaactacaaaacccatgttctggaaccactaagatcatcgtataaggaatcccagttacactcgagtatgaatgaccacaagatgggactgccccagctaacagtaaaaacaaaacttcagtgatgtgaatgaggctacctgggacctttcaacccattcaatctgccagatcactgcacttacatgtacaatctcaggccaggctagcaggagggctgcccagatgatcctagcctaaataactaaatcacagaattgtgagcaaataaatgttttaaaacactaagattgggaggtgaggttgttatgcaatagatgactgatacagttgttcaactgtcttatgcttccataagttcattttgttcataaatccccctcaaattatctgatttcatgtct

SEQ ID NO: 464398 - DNA, 2954 bp, Homo sapiens
tcgcttctgtctgaccaaggtctgttttcctgatcgagatagggcctttaagaagtgatgggggcatgggaactctgccctcatgaatggattaatctattcatggattaatggattaatgcattaatggattggtggtttatcatcgcaaggaaactggcagttttgtaagaagaggaagggagacagtggcagggaaactggcggctttgtagcaagaggaagtgagacttgagtcctctcaccacaggttgccctgcaccaaccaccacaggactctgtagagagtcctggctagcaagaggatcttcaccagatgtggcctcttgacctgagacttctcagcctccataactgttaagtttcctggagaattctgaaggatatgcccccttcctctcctacagctcagagttgttctgtgcacttggatcagcctccacaacttccccccgggacagggcacccatcaccatctcctacctggacagcagcaaacactgcccccgtgacttcctggtgccatccttggctccattacgtccattctccagtggctggcagagtgagcttgaagaacgtgtgacatgcccttcagaatgttctacttcctgttccagaaggacagcccctcatgccttcccgcgggccacacgccacctcttcctcagtgccccagcctggcatcctcttcctgcattcagccttcttttccgagggtcaacatcttgtgagtatggggaccaggcaacgtgagctccagctctaactctgtcccaatcagctgtgtgaccttgggcaagatgcttaacttctctgggcctcagttttctcatctgtgaaatgaagtgtcatcttgctggagggcagaaggattccctggaacctgggggccagcaggacagaggaaacagaaagtacatgaccgatgatgtctttcgaccacagaaagggctggaagaagcaggggacctactgtttgaataaacccagtggaaaaacagaagccccatttcatacttgactcagctcttcaagtttaaatcttgaatctcctcaactacacggaacagtgtctctcccaagtcatctgacacccactctgttctctggatcattccttcctagagaacgttgctcttggagggctgtgatctgctctcacccacttgcctttctgacccactgagtgcatctcaacagtcacttggggtgatccgatctgaccaggaagggttgggtggctcgtggagcttgggaagcactctcactgtggcggtccccattggtggtcatggggttgccacagtgagctacgtttctaccctcatctctctatatgttaccgtggaatctctgactgaggacccatgggctcacccaatgtgataaagtcctgaagctcagccgggacgtccgaccccagctgcaggactttccaatagacagatgcatagaacttgagaagaaatcgacttagaaacctgaagttggaaaactggttgcctgacattctgtgcaagactgaatctctgagaaatgaaggctgtgtaactttgggaccatgtcttttccagcctacatagacccccaggaaactttgcagttgttccccaagtatggatggagtcaaacttgatgtcctttcatccccccatcccatccactaatccatatcctttggaaattttagagtgccgggcctcatgtaaatacaccaaaaacaatttaagtcatttatgttctactaagccaagagttctttagcggtggaagaagatggggtcttacacgaatggaagggtcttggctatttgcgtcggtatcaacagaaggactagacgcttgcactaaaagaaaaagctgagggatgggggcaggaagcgggaagctgggacccaagccccaccttcctgagttggaaggtgacaggtagactcctgcttgtttgccagagaggcctggcagaggaggtgcatcccagcacagaagggcagcacagaggcagcctgagaagattctgtcgctgccaggtcaccaggacctctggaccacagctgggttgcgctgttttccagtttgtgaaactaggactttggggaacatcctgtgaattggtgtcattttgattttcctggaggatttttgaggtcagcgtgactgctgtcactgtaagtgtgggtgtgctttcccacaagaagcatcctgagtctgcgggaagagcccatgtcagctgaacaggatgtgtactggccgctgggttcagtgtgtgttgaccaggggccagcccccttcccgcttcagtccagctcaggtgtcagttgacggcttgtggaaatatgtgagtggagttctttctttgtgggtgtggacgaggcagctctcactcctgcgaggacgcgtccagctccttgaggagtacggtggcagggaaggggacagcactgtcatggagtcagatctgaatcacgtccacggagcggtttactttgggaattacctcctatacatttcaaattccatagacacgagaccgacagcacagactccttatggcaataagacaccaaattataagcagcacctcaggccacgccagcagctaaacacgcaccggccccgagattcaaacgactgcagctcatccacctgcagacgctggctgaccccgttccacagctgtgactatagctttgattggacaagaggttgatttcagtctcctgctcctcctggaacctgaatatgtatgtttggccagctcaattcagcatgaggctcctgctgcaacaccgcctccttccaggtgcctgccagctgtttctgccagaggctgcgtctcccggcctgtcagaatggccaccctgcaggctgtaatcctttagaagaaataaagatcccctttccagatgtatagatcttgtgatttttttccattcacatccttgcatctt

SEQ ID NO: 464399 - DNA, 2201 bp, Homo sapiens
tcgcttctgtctgaccaaggtctgttttcctgatcgagatagggcctttaagaagtgatgggggcatgggaactctgccctcatgaatggattaatctattcatggattaatggattaatgcattaatggattggtggtttatcatcgcaaggaaactggcagttttgtaagaagaggaagggagacagtggcagggaaactggcggctttgtagcaagaggaagtgagacttgagtcctctcaccacaggttgccctgcaccaaccaccacaggactctgtagagagtcctggctagcaagaggatcttcaccagatgtggcctcttgacctgagacttctcagcctccataactgttaagtttcctggagaattctgaaggatatgcccccttcctctcctacagctcagagttgttctgtgcacttggatcagcctccacaacttccccccgggacagggcacccatcaccatctcctacctggacagcagcaaacactgcccccgtgacttcctggtgccatccttggctccattacgtccattctccagtggctggcagagtgagcttgaagaacgtgtgacatgcccttcagaatgttctacttcctgttccagaaggacagcccctcatgccttcccgcgggccacacgccacctcttcctcagtgccccagcctggcatcctcttcctgcattcagccttcttttccgagggtcaacatcttgtgagtatggggaccaggcaacgtgagctccagctctaactctgtcccaatcagctgtgtgaccttgggcaagatgcttaacttctctgggcctcagttttctcatctgtgaaatgaagtgtcatcttgctggagggcagaaggattccctggaacctgggggccagcaggacagaggaaacagaaagtacatgaccgatgatgtctttcgaccacagaaagggctggaagaagcaggggacctactgtttgaataaacccagtggaaaaacagaagccccatttcatacttgactcagctcttcaagtttaaatcttgaatctcctcaactacacggaacagtgtctctcccaagtcatctgacacccactctgttctctggatcattccttcctagagaacgttgctcttggagggctgtgatctgctctcacccacttgcctttctgacccactgagtgcatctcaacagtcacttggggtgatccgatctgaccaggaagggttgggtggctcgtggagcttgggaagcactctcactgtggcggtccccattggtggtcatggggttgccacagtgagctacgtttctaccctcatctctctatatgttaccgtggaatctctgactgaggacccatgggctcacccaatgtgataaagtcctgaagctcagccgggacgtccgaccccagctgcaggactttccaatagacagatgcatagaacttgagaagaaatcgacttagaaacctgaagttggaaaactggttgcctgacattctgtgcaagactgaatctctgagaaatgaaggctgtgtaactttgggaccatgtcttttccagcctacatagacccccaggaaactttgcagttgttccccaagtatggatggagtcaaacttgatgtcctttcatccccccatcccatccactaatccatatcctttggaaattttagagtgccgggcctcatgtaaatacaccaaaaacaatttaagtcatttatgttctactaagccaagagttctttagcggtggaagaagatggggtcttacacgaatggaagggtcttggctatttgcgtcggtatcaacagaaggactagacgcttgcactaaaagaaaaagctgagggatgggggcaggaagcgggaagctgggacccaagccccaccttcctgagttggaaggtgacaggtagactcctgcttgtttgccagagaggcctggcagaggaggtgcatcccagcacagaagggcagcacagaggcagcctgagaagattctgtcgctgccaggtcaccaggacctctggaccacagctgggttgcgctgttttccagtttgtgaaactaggactttggggaacatcctgtgaattggtgtcattttgattttcctggaggatttttgaggtcagcgtgactgctgtcactaactaaaataaaatccgaagtccccaagtg

SEQ ID NO: 464400 - DNA, 1658 bp, Homo sapiens
gcccagtcttccagtcgctgccaaattaatgagcccacgtcaggttgggtttacagctcggccgggaagcagccgagtggaaaatgagctcggggcctctccagaggctcccgcacaactgcagaggctgcccgcgtccctggccgccgcaaaggccgggcgcagcccaggagaccgggagtcgcggcccgcgcggttccgccctcggcttcgactttagctgcctccagagggaacaggcctggtgtagcgaaacctggtaaggagggtcacaagagagattcttgtgtgagatctggtggtgggagagaagcagcaaccttcattgttcaccttccaattcaccctattggtgtgatacggcagccaggccagcaactgctccatcttctcctatactctccttcaactgctctgactcttgggccaggagcggtgaaaaagaagaggcaagaccggcccccagaccgaccaaagcccacgtgccgccacaccccacgcccagcgcgccgacgtcccgccactgtcgctgccaccatcatgcccaagagctgaaggggatgctagagataaagccaaggtgaaggacgaaccacagagaagatccgcgaggttgtctgctaaacctgctcctccaaagccagagcccacgcctaaaaggcccctgcaaagaagggagagaaggtacccaaagggaaaaagggaaaagccgatgctggcaaggagggaaataaccctgcaggaaatggagatgccaaaacagaccaggcacagaaagctgaaggtgctggagatggcaagttgagtgtatgcattttggataacagtgtacttctggtgactgtacagtttgaaatactattttttatcaagttttataaaaatgcagaattttgttttactttttttttaagctgtgttgttagcacacggaacacttcattgctgtttttggggtaaggggcatatgtcactaatagaatgtctctgaagctggattgatgtgaggaaaacaactttcccttctagttttgagagacttcctcttggctcccaggaggagggattccctgactttgacacacatggccaccttggcacaaaagccttgtggtatggaaatacaaatccatttttatttgttgtatactgttaacaattgtctgcccatatcctgcctgaaatgccatgattgtttatggaaagtatctttaataaagctggatacagtttggcttggaaaaaaagaattaaaatatagattcataggctccatcccagatccaccaagttcgagacccacaaacgctggtggtgtaaattccagtctgagtccaaaggcccaatttatccaggggcaccaatggcataaatcctactccaacagcaggagaagactgatgcccagctcgcaggcaggcaggaagaaaaagggacgaattcctccttcttcagccttctattctattcaggccctcaatggattggatgatgccctcctccactggaaaggaaagataaaccagaatggccagtaacaccacaccttggggttatctttactaaatatgggccctactgaacagaaattagagcttatcacaggacaacaaattttgtttgaaaataacctttttactacttttttatctgactct

SEQ ID NO: 464401 - DNA, 1699 bp, Homo sapiens
caggccatctgggcatacacgtgcaagtcacaggggatgcgatggcttggcttgggctcagaggcctgacaaccccaagctcaaacaaggtttctggtgcagccctagatgccatccttccacagttgcatcagtgccttctcggcagactcttcagctgaagccatagcccaggcaaaggacctcctcagccaggaggacttaaaagctgctatgagtgctgtgtccatgggatcaagggagtgtgggctggtggtctcgctggcttcaggagtgaagccgcagaccttcgcggtgagtgttacagttcttaaggcggcgcgtctggagttgttcattcctccccgtgggctcgtggtctctctggcttcaggagtgaagctgcagaccttcgcgagccaagtggtctgttttgacagggtgctgattgactcaggagcccagctggcttcacctagtggatcccgcaccagggcagcaggtggagctgcctgccagtgccacgctgtgcgctcgcactcctcagcccttgggtggtcgatgggactgggtgccgtggagcagggggtggtgctcgtcggggaggctcgggccgcacaggagcccatggagtgggtgggaggctcaggcatggcgggctgcatgtcccgagccctgccccatggaaaggcagctaaggcctggcgagaaatcgagcacagcgccggtgggccggcactgctgggggacctagtacaccctctgcagccgctggcccgggtgccaagtccctcactgccttgtgcgagcagggctggccggctgctccgagtgcaggcccgccaaacccacgcccacccggaactccagctggcccccaagcgtgcacgcagccccggttcccgctcgcgcctctccctccacacatccctgcaagctgagggagccagctgtggccttggccagcacagaaaggggctcccacagtgcagcggtgggctgaagggctcctcaagtgccgccaaagtgggagcccaggcagaggaggcactgagagcgagcgagggctgtgaggactgccagcacgctgtcacctctcaactcagtctcccacatggcgtggccacccttgtgtctgttaaactctttctctacaaaaatgccatggtctttctttgtgcagtggtcaggaaaaaccccttgggcagatacaaaagttctttcaggcatctgtttccagaatagcgaggtttcctccatattgaagatttgctgtggcaagtaaatctcctccataatcaagcttccaaaactcttcagctgccttcacatcagcacccacagactcagcattcatgttaacattatgtaatgcataacgatcctcaaatcatgtaaaccacccggaactggcagtaaatctgataccaaagtcaggtccagcctttcctttcaacatcaaaaacatactttttgctctggccatgaccgccgtggtgctgaaaccgcctctgcaaaaattataacagaaaattatgaccgtgaaaggacaactaacctaaccgactccatcttgcttctaatctccaagctgtccttgttcatccccgggcgtaggctcaacctactttgggaggaacttagtttacagtgtgaaaggaaaataaatcttggggccccaaaatcactaagccaaacttgactcttccccgtggcttgg

SEQ ID NO: 464402 - DNA, 2634 bp, Homo sapiens
caggccatctgggcatacacgtgcaagtcacaggggatgcgatggcttggcttgggctcagaggcctgacaaccccaagctcaaacaaggtttctggtgcagccctagatgccatccttccacagttgcatcagtgccttctcggcagactcttcagctgaagccatagcccaggcaaaggacctcctcagccaggaggacttaaaagctgctatgagtgctgtgtccatgggatcaagggagtgtgggctggtggtctcgctggcttcaggagtgaagccgcagaccttcgcggtgagtgttacagttcttaaggcggcgcgtctggagttgttcattcctccccgtgggctcgtggtctctctggcttcaggagtgaagctgcagaccttcgcgagccaagtggtctgttttgacagggtgctgattgactcaggagcccagctggcttcacctagtggatcccgcaccagggcagcaggtggagctgcctgccagtgccacgctgtgcgctcgcactcctcagcccttgggtggtcgatgggactgggtgccgtggagcagggggtggtgctcgtcggggaggctcgggccgcacaggagcccatggagtgggtgggaggctcaggcatggcgggctgcatgtcccgagccctgccccatggaaaggcagctaaggcctggcgagaaatcgagcacagcgccggtgggccggcactgctgggggacctagtacaccctctgcagccgctggcccgggtgccaagtccctcactgccttgtgcgagcagggctggccggctgctccgagtgcaggcccgccaaacccacgcccacccggaactccagctggcccccaagcgtgcacgcagccccggttcccgctcgcgcctctccctccacacatccctgcaagctgagggagccagctgtggccttggccagcacagaaaggggctcccacagtgcagcggtgggctgaagggctcctcaagtgccgccaaagtgggagcccaggcagaggaggcactgagagcgagcgagggctgtgaggactgccagcacgctgtcacctctcaactcagtctcccacatggcgtggccacccttgtgtctgttaaactctttctctacaaaaatgccatggtctttctttgtgcagtggtcaggaaaaaccccttgggcagatacaaaagttctttcaggcatctgtttccagaatagcgaggtttcctccatattgaagatttgctgtggcaagtaaatctcctccataatcaagcttccaaaactcttcagctgccttcacatcagcacccacagactcagcattcatgttaacattatgtaatgcataacgatcctcaaatcatgtaaaccacccggaactggcagtaaatctgataccaaagtcaggtccagcctttcctttcaacatcaaaaacatactttttgctctggccatgaccgccgtggtgctgaaaccgcctctgcaaaaattataacagaaaattatgaccgtgaaaggacaactaacctaaccgactccatcttgcttctaatctccaagctgtccttgttcatccccgggcgtaggctcaacctactttgggaggaacttagtttacagtgtgaaaggaaaataaatcttggggccccaaaatcactaagccaaagcagaaagtcaagctgggaactgcttagggcaaacctgcctcccattctattcctaaaaaagatagctactacgattaaaaagctacatacctccctcacaaggaaattccttgtggacaaatgacagaactcaaagccacctctgctcactgagatagatgcgtctctgcctgcctcctttggaaaggccaatcagaaactcaaaagaatgcaaccgtttgcctcttatctacctatgacccagaagtcccctccctgcttcgagttgtcccacctttctggatggaaccaatgtataccttacatatactgattgatgtcccatgtctccctaaaatgtataaaaccaagctgtgcccgaccaccttgggcacatgtcgtcaggacttcctgaggctgtgtcacgggcacacatccttaactttggcaaaataaacttcctaaatcgactgagacctgtctcagatatttggggttcacaatggtttaactttgaaacaaagacaataacaactcttttccaaaacaaagtccctgcctgcctgaggatcagactgcctttgtaggactaacaaatttgccatgagattagaaattatggtgtaggagtaatgcagctggaggtggcgggattctgaacctccttaaattgctcctgtgataacctaagatgagtgcttaacatcttttacagaccctgtattcagtggatcagctggcaccacccaaatagataaattggcccatctggtcttgtggcccccacccaggaatggactcagctcaagaggacagcttcagctccctaagattttatcttggacccgaacaatcagcactcccgacttactggccctctactcaccaagttatccttaaaaacctcaatccctgagttttcagagagactgatttgaataataataaaactccggtcttccacacggccgactctgc

SEQ ID NO: 464403 - DNA, 646 bp, Homo sapiens
tttctttttttttttttagtctagccgttctcagcatcaggtgactctgctccttgaaaatacatttaagtgatgccattcctgtccaaaaccaccactgactccttcttcagagggcaagccttgaaatcatgtgcatttgcctgtgagacgtttctccgattatctgaaaatcttctgccagggataaggcgatttgtctccattctgtctgaggttgcggatcttggtgcggcctcttgctgccctctggtggagaaaacgggtattgaacaagccataacgactgatctctgaggcaaatgctgtgaagtgtcagcgcaaaggtccacggggaataattacacttcaagctattatctaaatgaacggagttcatctaaatgaatggagttggaacggttgttctatgagaatctgatttctcagcaagagaagttttaattccatcccctttttatttctgtttgctgcgaactggtttctcatttctccacacttgctcttccttttcgtgaacaatcattttgtgtattttgagatcattataaaattcttgtacgctcattttaaaacatttccagaaagtgaaagtcagcatgtgacccaggaaaattctaattcttaaaacactcaagactctaaa

SEQ ID NO: 464404 - DNA, 1527 bp, Homo sapiens
tctgctcaagaatttcctgaatatttgacaatatgttcccacaaggacctgccaactccactcataatcgtgaaacactgaatccttaccaaaaaaggaatgcttccaggaaaatgtcatatggtgtgtttgataatttgggactcaggcttagatactgtcagggacgcagatccagagccagagaaagaacgaggaactgttccagactgaaggagaacaatgagacaataaatattcctggaacaaggaaaaacatggtattgggactgttggagaaacttgaatgggattaccggattggaagacatgatcactgccttcaaggcccagaccagagcagagcccacaggtcatgcagcccttggactgttctgaagatggtgattccatggtgggagagtttccgagtacccctccttggttgtcatattattgataaatgaaaaaaatctatgaccctatactattcatttttatatggatggcttaaggatccttcaagatcacagtagcattcattcgcatatcaagtaattattgagcacctgctatctgctaggcctttttcagatggagtctcactcttcgtcaccgaggctggagtgcagtggcatgatctcactgcaacctctgcctcccgggttcaagtgattcttctgcctcagcctcctgattagctgggactacagatggagtctagctctgtcccccaggctggaatgcagtggtgtgatctcggttcactgcaacctctgcctccaaggttcaagtgattctcctgcctcagcctcccaagtagctgggattacagtctagccgttctcagcatcaggtgactctgctccttgaaaatacatttaagtgatgccattcctgtccaaaaccaccactgactccttcttcagagggcaagccttgaaatcatgtgcatttgcctgtgagacgtttctccgattatctgaaaatcttctgccagggataaggcgatttgtctccattctgtctgaggttgcggatcttggtttgcagaggagggctgcaacgtagtaggttcctccacgtggcttctcactgaagccagaatgactcatttagagagtaatcttggtgcggcctcttgctgccctctggtggagaaaacgggtattgaacaagccataacgactgatctctgaggcaaatgctgtgaagtgtcagcgcaaaggtccacggggaataattacacttcaagctattatctaaatgaacggagttcatctaaatgaatggagttggaacggttgttctatgagaatctgatttctcagcaagagaagttttaattccatcccctttttatttctgtttgctgcgaactggtttctcatttctccacacttgctcttccttttcgtgaacaatcattttgtgtattttgagatcattataaaattcttgtacgctcattttaaaacatttccagaaagtgaaagtcagcatgtgacccaggaaaattctaattcttaaaacactcaagactctaaa

SEQ ID NO: 464405 - DNA, 2840 bp, Homo sapiens
agtaggcttcagaagatgggtaacaaaaaaatatgcaagggatgtgtagacctcctcaaggagaactacaaatcactcttcaaggaaataagtggaaaacaaatggaaaaacattccatcttcatcaataggaaaaatcaatattgtgaaaatgctaagacaatcctaagcaaaaagaacaaagctggaggcatcaaattacctgacttcaaactatactacaaggttacaataaccatatcagcatggtactggtaccaaaacaggcatatagaccaattgaacagaccagagagctcagaaacaacaccacacctctccaacaatcggatcttcgacaaacttgacaaaaacaaccaatgggggaaaggtctcctatccagtaagtggtgctggggaaacaggctagccatatgcagaaaactgaaagtggaccccttccttacaccttacacaaaaaataactcaagatgggttaaagacttaaatttaaaacccaaaaccataaaaaccctagaagaaaaatgaattttataattatgttttagaaaacatattcttttatacattttgaaaaggttatgtcatagccatagattcatttgattaaaaaaataaagatttcacattttcatttgtgtcagatgtttttaaaaatcctaatgtacagagcaacagaatactgtgctgaggccccaaaacagaaaggaaagctcaccaccagaatgtgccttttccttatcaaaaagaattgctgccccttacaggacaggaggactccaattgtgaccaagttggagcagccttgagccacaactcagacttattttcattctctgctcattggccattaggaacccgatccttatgacctgcagtgacctgctgctaccagaactgactcgcttcaaagtgacggatgaaacccatatggagatattcctggggtgggtaggccagttggaagacagagtgtttacacctgagagaggacttgagcatatctgaaccttttgcaccattcagtaaagagaaaaggggagctcagaattttactcagtcacgttgctcactgctgcgcactcctgcagacgcatcccagtggactctgcgctgcatccccagagtacagcgagtttcccgcctcccgttagagatccaacacatattttttttgaaagaagaaactgatggaagacaggaagcaaaaaggagaggaaggaaagggataggaaggaggggaaggaaagggaaaggaaggaaaagaaaggaaagtgaacttgaaatcctacaaggtctcaaagtcaaaaaacatgattgctgttttagagaattgaagatccttcatcttcaagaatctgaaatctaccatgatcttcacatgtagccaaacacaatgggatgtagtcatttaagagtgctgtgaaggcagtgaaaagcagttgaaataccattagttaacagattgcccaatgaagtcgatgacaactgtgataacaagttactcactatcacagcgtctccaagagatgaacagtggatgatgcttccaaagcacagatgtccctctcctcctcaaccttctctccccagaaagatgtcaacactgtggagattgtgctatgaagatacctggtgtggcattgcaatagatgaaatattaagggcaattcaacaattttctgaacaaatacatggatttaacttgaagttgaatttaatttgacttcaagaaaaattatatttctggtcctcctatgatcatgcactaagaattatttaactgcagatacaattgttacctttagagctagaaggcctcattttagaattaaaatgaatggcaacccagacagataaagtcgagtcgtgatcatcccactgcggaggcagagccagtgctggccatcccccgaccaccccaacacactccaggtctcacacatttaatctctctctctgccaagggaattttttctttccatttattcttagaaacaactaagggagttttaagttaaatacatgctgccaaattgaatccaaggaaactaaagtcaaatatattagcaaacacttaatgtcctctccattttgacatttctccctcaattcctatttctgagtaaaggctgttcagatgaataaaaacatattttcagaaatctgagctcataagacctataggtctgtgaagtcacagaccgtgcactgtcagcagtcagcaattctgctgggttgaattggcatgtttcaaactatgtatttttgttaaaaaaaaaaaaaaaggtgtgtaaatgcatttacaaaatagtttgtactctttcccagtaattcatagttgccttcacagcacccagttccggatttcacaccaagcctttgctgaggatatgagagtaataaaaaggggagccctggttcttcctctcctttagtgtctttcctggaagtggactgcgagaagagcttcttcagccaccttctgcctgcagacaacctccatgagtttgctttagaagaaggcttcaatttgaagaaagtcaaataaaacaaggtagactatcattcccatagatgcaaaagaaggtgaacccagattcagatcctaagtcagccattctgcagggaactcttaggtgtccaggtcagaggctctactcaaactgcctcatcaatattgattcctcagttgttgcaaatataccacactcatgcacgttgttaataataaaaggggaactgtagaggacggggtggtgtatatgagaactctgtactttctgtgtaatttttctataaacctaaaatagctctaaaaataaagtttattcagaaac

SEQ ID NO: 464406 - DNA, 1764 bp, Homo sapiens
gggtgcaggtctacccatgttgtagcacaccaaagcagctgcaaactttcctaggccttctatgactctagtttacatcggaattgcccggagggcttgttaacctggattgcttggcactgtccctagggcttttgattcagtaggtctggtatggggcccaagaatgtgcatttctaacaggttctcggatgatgatgatgatgatgatgatgatgataatgctggtccagggccagtctttgagaaccactactctaagtattttatgcaaaaagagcagcccattgaagtaatgggtcctcaaacggatgagcaggaagcttccggtcaggattctcagggcagcttagggctggggaaccacgttctgacaagcatcgaggcaaacaaggaccacgtctgcatgtctgccctctgccaagagggttcctgtggaagccaccagcacattgagagaagggaaaatgtggttattctgcatccattttactgcaaggagatcggggctgacgtggctggccaattcacaacctgtctctaatgtattcccatttgagaaactgatcatggacagctaagtgaaatgtctgacttctctcctggaggctccctcactctcttctgccagaaatgagacccggggaaaaacagcggtatcatctatatccctgctaacttcctgtactgcacatattggaggactcagacaccgacttgcctgtggttgctatgagtcgcctacagaactgaaaatgggaagcagaactaggctggttgtactcctaaccacaaggacactctcctcctcaaatgaaaaggctctaattaaaaggcaggaaagatctcgtgtctctggagttcacttttaaaattgtcaaaaaaaacctcaaagtcgctttgcttctgactatccatacattggaagactaattaactatgacaagctgaccagtggagaccattttcataaggatgacacgatgatggatgggtgcatgctgttacaatgtcattgctaaaaaagacgtgatgagtccaagttccaattactaagattcatatacaatacagaggtctttttcaagccacagaaccccattgcaacaggctgacgtgtcgtcttttctgtatttaagagacacattcatgggccggtgacatactgagctatgcatgctaggccttctctgcatctggcagctggaacgagacacaactaagtcttgttgcttcagggctttgggtaccaaatgaggcattagcacaatagaaacacccaacccagagcaatgttttcccatcttcagacttggaggccaagaggcaatagcaaggacattatgtagatatttatacaaccatttaaaacataaccactcaaaaatgtcaaaaccattcttagcttactggctgtaaaaagtaggcagctggctggattgggcccacgggctatagtttgccaacccttgccttaaataaacaaacttgttagatttctcactagtgttatatttctgcagctaaagttctcttagttacacaaaatttctcttaggtacagaaaatctggtcacaagaagtttgaaaaataaattaacataaaattatatacagtcacatattactaagatatgtaacgtattatattagtatatgttattataatatacaattttatattataataacatatgatatatattaatatattacttgtattaaattaatatatggatataataatatattaatatataaata

SEQ ID NO: 464407 - DNA, 1219 bp, Homo sapiens
tgagaatttagcttcctctgcacgatgcctgtcagggtccttggttgtcatctccatcttagcgatgcagtcttttaggtgctttaaataaagggggagagaggaaatcttctgaagcagatgacaattatttcccccaagcacagccaccaagccatgctcttattttgaatgatctgcgtcattttccaacatgaagcctcagaaggacatgattacaggctggactcaccgactgtagcctgtgcagctattgtaatgttttaatcagtgattaagtcaagaggtttaatttagtaccgggctccgttaagcttgtgaaaatggttttctgcctcctcaaactaaaaatgtgtctctcccccatgtgtccagcccgaagcatcttaacctttgttctatcttcaacaccgctggctctaacaaattactcagcagtgaatgaattagctgagtccaatgtgtgaaaaaagattaggctggacctaggaaaattagcttctaagcacagcacaggatgaggcataaagatacctggactcgtgccctgcatgacaaagaagctaagcttcattagcgtcagtcatgacatccgtcattggcattatctcattgaatccctgcgacaacctcaggggcagatgctattattattcgcattttgtagatgaagaaaactgagacccagagaagcccctgatagtgagtggcagtccttggctttccttggcttctagatgtgtccctccagccctgtcttcacgtggccttctccctgtgcctgtcttcacatggccgtcttcttacaaggacaccggttatatgaggccacttatagggacttggcgtttactctgtgtgaagtgggagccgtggaggacactgagcagaagagagggaaggcagacaccacccctaccacacccccacaaggaagcagggcacattacatcacggtcattgctgtgaaaggatcatggcaatgtggtgcgataatagagaatcaagaggtgggaatgaatctaatacagactgtgacgagtgaaggtgtctcagaggagccaggtctggaagcaattgtgtacactattgccatccacattccactggccagaactcagtgtcatggccccagcctgtctgcaaggctcctggatccaggaggagcagatgacttgggtggcataaagacttgcctctgcacaatgaactaagcatt

SEQ ID NO: 464408 - DNA, 778 bp, Homo sapiens
ctgcgtcggtatttgtgaaatgttttgagcctctggatttaaataagctcccgcccccacccaggcctgctcagaagaacccaagccactcagaagcaggaggcagccttcaccccaaccagaccaatatccgttccagactcaggattacaacaatctgggagagggtcaaccaagtcagagtcccacatggcagaagagctgctttagcttaagactcttaactctttttcttcggggcaggaaaggtttgagccaatgaaggatgaggctttccaggcccaggacacaaccttgatccaaggcctagttgtggctttaatttttgtaaatcaagcctcaagtttttcttcactcttttagccaaagatatgtttcccaggatgcatgaaataaataaataaaatgtaccaaattagagattgtgagacatgtatgtcacttaaatcctttgtaggcaagcaggaatcactgattcactaaattctgtcctaagtttttttttctcctaaccattgtcttcataagatcatcccatacttggaaaacatttatctaattatcatcacacacaatgggcccgctgccagctgttttttattttaacttcagattctttccagggtgtttgtttgtttttttcttgggggtggggagtaggagagaggagtgtgtgtgtctgtttttgctattacacagaactgatcagatttccttttataatcacaattaaacttccagacccaatcatctgaatatttcatgtttagaagatctc

SEQ ID NO: 464409 - DNA, 1501 bp, Homo sapiens
gtgctatatgagggttagctgtaaggatttggagaaatacattatacgtcaaaagtcatgtccagttagaacaaagccatatacaagaatgcacaggaagaatactttggaattagacaaaaaagagaaatccatgggattgaaattgaccacccatgaatatggggctgccacccctaaggaggacctcaggcatcttttccctagcaaatgttctggatctgcccactctgtggctccctccccagctggccttttggcttcatctttgattcctggctcttacccatgtgctattggatcaggtgagagatttcagttcaggttaacatactttaggatgggtctatgctgagtgaggaactggggctaaaaagaagaacgtgtttgcttccccttccaccatgattgtaagtttcctgaggcctccccagtcctgcagaactgttcttttaaacatttatcttcagaagtctttatttgtgctaagtcacttagatcaaaacaaaaacacttatttttgtgtttgcttaaacaacgtagatcgtttcttcagttatctcctggctatatatgtggacacatcttagatctagagactaagaaaagtattttcttgctgtcctgtactttctacacatttgtaacctgtgttcataacaaagtatatgtcctctgcgcccccataccatggtgtaagccccaggagagcagaaacttcctttgtctacccgacagggctgaagcctcagagtctggatcagtgtcagctcccgcccccacccaggcctgctcagaagaacccaagccactcagaagcaggaggcagccttcaccccaaccagaccaatatccgttccagactcaggattacaacaatctgggagagggtcaaccaagtcagagtcccacatggcagaagagctgctttagcttaagactcttaactctttttcttcggggcaggaaaggtttgagccaatgaaggatgaggctttccaggcccaggacacaaccttgatccaaggcctagttgtggctttaatttttgtaaatcaagcctcaagtttttcttcactcttttagccaaagatatgtttcccaggatgcatgaaataaataaataaaatgtaccaaattagagattgtgagacatgtatgtcacttaaatcctttgtaggcaagcaggaatcactgattcactaaattctgtcctaagtttttttttctcctaaccattgtcttcataagatcatcccatacttggaaaacatttatctaattatcatcacacacaatgggcccgctgccagctgttttttattttaacttcagattctttccagggtgtttgtttgtttttttcttgggggtggggagtaggagagaggagtgtgtgtgtctgtttttgctattacacagaactgatcagatttccttttataatcacaattaaacttccagacccaatcatctgaatatttcatgtttagaagatctc

SEQ ID NO: 464410 - DNA, 3538 bp, Homo sapiens
cggctttatctgagaaagcttttaaaggacttgcaatacgaaggaaataattctgaggcaatagctatgaagcttccaatcatggcagaaagcaaaggaggagccagatgtcccacatggtgggagcagaagcgagagagaaggataccacaagagctcgcgcactatcatgagaacagtagcagggatggtgctaacccattcatgagaaattgcccccatgacccaacccccaacaaggcctcacctccaacacaggggattacaattccacatgagatttggtggggacacagatccaaaccaccttactatgattgctttcaccaacgaattcttaagaggaaggtgaaagcagttacaattcactgtctaatagccaacaagatctttttaaaactcaactccaattatgtatatcctctgattaaaagcttcctctacctttccatttcacttggagcagaatccaaactccgcaccaagggctgagatggtccggctcccttctgcctctgtgtctctgcccacttgcttactaggatccagccatactaattttctttctattcctccaacagttgtcatcggaatcacaagaatcctaattgaaacatctggaaaaaccacaatgataaaaagtatttcagaaaaaaatttttagtaactgaaaatcaaccagaaaaccaaaacaaacaaacaacaacaacaacaaaacgtgctttaatttaaaccccggcttaaaaaagttatttccaaacggtgtgagccttcttctcgtactgggaagcctgaaaaataaattccattcccctcacctttcaatgtgtctgtatgcctaacttttcctggtcatgtgacaagaacccagttttggctgaattaagaagcaaagttctatatgagtgatcaatatgagtgatcacagctcagggaaaatacaaagccaagaaaccttgagagatgggggtctccctattttaatcgttcatgtcctggaatatcataaaacaagttatatttattgggaaaaaagtaaaaagtacaccttaatcatatttttctgtttaaattgctttgacagttttactaaggcttttacactaaccttaatgtagaagattcattcttaccatagattttagcaacttcagcataccattttttctcaccttattaaatgtagaactttcactttttcactgaaaggaagcattttacagcttctctttggtatatccaaattgtcagcatcactactctcgtgctttgaggccatgatgaagtaaaagaagggttacttgaacataagcactgcaataccacagcagtccacctggtaattgagccggctatgaagttactaacagatgggtgggtagaaagtgtggatatgctggacaaaagaaggatttgtatccaaggcgaggtggagcaggagcgcaggagatttccccaggccactcagaacggcccacttcaaatgcggagagatacacctgcagtttctgaatggatttcttcaacaatgccgcctaattgactcacattaaaaatactttgatcgacccatctctttgtcacatgaagctggaaacactaacagaggctgttggaaagaaaggtctggttccgtggccaaataccttgacttttccaaaaacagactttttctgtctcttcagaagaagaattacatgcaatgggaagattgatgttcctctgtcagaaagctaccttggaacaggtgctcccaattaatttccatgagccacatttatcctgtggtcagataattaaaaaaaaaataacctggataaaccttcttttgccagtctaataaccacatttgatgtaataaaacagcaagcacttaggaatattccaataaaaaagatttatttttattctagtatatattataatgaataatattattgatattatagaatttaaaattacattaaatcagagctatttatgtttattatgcaaaatgtacacaatatagaaaaatataaagaaaaatttcaatacacaaagtatggatatgctttattttcactccattttcacatatatattgacacagatgcagtcaaacattatttagagttttatgaattaataacacagtcattaaaaagtaattaaccaagtaatattcatagtcattgcaaactaattggaaaatataaataaataaaatataagcatcactttctttttagtagcacaatactttttctgatacatgttatttctatttttttgctttaaaattcaaaagattatatttatgcagtaatggatttttgtggttgttatagagcccatgtgccctggggaaggattttaaatatcatgaaactgagttctttccagttttctttctcattaaggggactgaagagatcagccccttagcaaagatttgactgagatataatagagacaattatgtactctattaccaattcggatggactttatggtatttaaatgaacaaagctctctttgtcatttcattaacatgattccttttcagagaatgagcagttctcatctccttcctccattttgggaaaacagcccaatttttctcaagctcatttgaaaggcaaaatggttgttgatctctccataattgattgaggatgtgtctggccgctgagagtacctgaatccatggcttatatcagaccacactagatttttctgtatacaaccaaaggcttatgaccatattaagtatggggaagagaattgtccttgtgtatctacagttcctaagactattttgcatacaataaactgatcaaaatcagctaattgaactgagtttggaaaatgcatgtgaattcagttggcagacagaaatcacgctgtcagatcagctatagcatataagaggggaatgagaagacaatgaaatcaaggatggattaatctcaaaagggagagaatatgcactaacaaatcctgaagtggaattggaagaacagagataatagccatggatcaagaagaacaaaacaagctgataattgaggagtcctgttgatcgattcacattttagaccctaattttgacactgtcaactgataaacatagtcttccagcatttctttcagaggaatagctcatatgtctattaaatatgagttaaaaatgacctgaatgtctatgcttctttgtagtaataataataatttgaaaatcttggcatttctagaaacttctgtaggttaagtcatatctcatcccccaaaatcttgtctttcatgatgccaacaaatacttgacattatgtaggtaaatcaagtgttgcaagaaatgtttatgtagtctctatacatttaaagccaacagctttactccctttcttttgaagcataaactccattttggatgatgtggtggtgaggtgttctggttcttatgcagcaaatcgacggcattaacatgtttcaactatacattatctgagaaactatcagtttttaaaattttttattcataaaatatcaaggact

SEQ ID NO: 464411 - DNA, 2112 bp, Homo sapiens
agctgtcatttatccacttttccattatcacatctgaatcccacaggcccacttcaaatgcggagagatacacctgcagtttctgaatggatttcttcaacaatgccgcctaattgactcacattaaaaatactttgatcgacccatctctttgtcacatgaagctggaaacactaacagaggctgttggaaagaaaggtctggttccgtggccaaataccttgacttttccaaaaacagactttttctgtctcttcagaagaagaattacatgcaatgggaagattgatgttcctctgtcagaaagctaccttggaacaggtgctcccaattaatttccatgagccacatttatcctgtggtcagataattaaaaaaaaaataacctggataaaccttcttttgccagtctaataaccacatttgatgtaataaaacagcaagcacttaggaatattccaataaaaaagatttatttttattctagtatatattataatgaataatattattgatattatagaatttaaaattacattaaatcagagctatttatgtttattatgcaaaatgtacacaatatagaaaaatataaagaaaaatttcaatacacaaagtatggatatgctttattttcactccattttcacatatatattgacacagatgcagtcaaacattatttagagttttatgaattaataacacagtcattaaaaagtaattaaccaagtaatattcatagtcattgcaaactaattggaaaatataaataaataaaatataagcatcactttctttttagtagcacaatactttttctgatacatgttatttctatttttttgctttaaaattcaaaagattatatttatgcagtaatggatttttgtggttgttatagagcccatgtgccctggggaaggattttaaatatcatgaaactgagttctttccagttttctttctcattaaggggactgaagagatcagccccttagcaaagatttgactgagatataatagagacaattatgtactctattaccaattcggatggactttatggtatttaaatgaacaaagctctctttgtcatttcattaacatgattccttttcagagaatgagcagttctcatctccttcctccattttgggaaaacagcccaatttttctcaagctcatttgaaaggcaaaatggttgttgatctctccataattgattgaggatgtgtctggccgctgagagtacctgaatccatggcttatatcagaccacactagatttttctgtatacaaccaaaggcttatgaccatattaagtatggggaagagaattgtccttgtgtatctacagttcctaagactattttgcatacaataaactgatcaaaatcagctaattgaactgagtttggaaaatgcatgtgaattcagttggcagacagaaatcacgctgtcagatcagctatagcatataagaggggaatgagaagacaatgaaatcaaggatggattaatctcaaaagggagagaatatgcactaacaaatcctgaagtggaattggaagaacagagataatagccatggatcaagaagaacaaaacaagctgataattgaggagtcctgttgatcgattcacattttagaccctaattttgacactgtcaactgataaacatagtcttccagcatttctttcagaggaatagctcatatgtctattaaatatgagttaaaaatgacctgaatgtctatgcttctttgtagtaataataataatttgaaaatcttggcatttctagaaacttctgtaggttaagtcatatctcatcccccaaaatcttgtctttcatgatgccaacaaatacttgacattatgtaggtaaatcaagtgttgcaagaaatgtttatgtagtctctatacatttaaagccaacagctttactccctttcttttgaagcataaactccattttggatgatgtggtggtgaggtgttctggttcttatgcagcaaatcgacggcattaacatgtttcaactatacattatctgagaaactatcagtttttaaaattttttattcataaaatatcaaggact

SEQ ID NO: 464412 - DNA, 1294 bp, Homo sapiens
cccttgtttggtgacctgcagggtgtcctttctgggactgagaggtgacgtctagagcatggctcagccccactgcctcttggtctctcagggatggtggctggccttgggagaaaatgggactgagaggagggcaggagaaggtcagagagaaacgttcgcttctgaggctgctgctgagatcttccttttggggtactgttttctgagcccctacagagccatgccctatgcagcagtggttggtcgatacaaggaattaacactaatgctatgtgcaaatgggataggaagaaatggcagcatgcattatgcacacctctcctctgctcagcttaggaggggaagcaccaaagacccatcctacacatgggcacagcacaagccagaggaacagcagctggctgcccttggttgtgatgggccctaccttaaaagtggcttggaggggaccaacagggctttcagcattcagaaagaggcccacacataagcagggacattgacatcccagtttgaataggctgcctggaggggatgttataaaacttcaatcatcaaccccccatctttaagcctcatatttttgtatgattctcatgcccatatgcacgtcaataaatgtgtatgccttttttctttcaactattatcaatttgttttatagactcaaattatcgaaacttcagaggaaaaatttaaactttcctacaccagaatcagcttgagagaagaacctagttgccaccccagccagacactcccttgcaccatatttgcttgtctaatgatgtacttgcttagaagttccaggggctaatcttgaaataaaccaggcatagagatccagttgtggaagtctcccccacctagaaattgcctcaaggtggttaatctacaacccaaccattgtcaaaatggccccagttcatactacaggtggacaacaactcaagatagccattggagcaagatatgccgacctccatcctgcaccactcccacatgcttcccataccaagtttcccttcccaacccccttcgcttagcctgaaaatttgagatggttctttgagacctaagtccagccattcttctcaatggctagcctttgaataaaactgctttcctccattccatcttgcttctcttgttttggcttctgagcggcaagcagccagacctcagtttggttaaacctggtcattgtgtgtcaagctaaactctttaatttctctcatagaactatggatttgttttgaatatctattgtctgtcttcaaaaaaataagct

SEQ ID NO: 464413 - DNA, 886 bp, Homo sapiens
ccggtacaatgtgagataactcgtgtgaaaagtggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctggtaggaccagaaaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagtacaaagtctgggttgcttagtctgaccttcgaagccctctagagccccttccaactgccacagctgcattgtccacctctctcagagttgcccctgctggccgtcatggagctgtgttttgctttgttttgttttgttttgttttgttttgttttgttttgtgttgtgttgttctaacattcgtgtaccaagcactgttctaggtgctgtggcaatattccagcccagggaggcagactggggctgacccacagaaggggctcagtggacattggttgaatgaaactcacacgagtcctttgaggacaggtcattgatgccatttttcacaggggagcagagtgaggctcagagaagggcagacaagggccagcagcccgctgggcagagttgccccaggggtacccaccttggtggggcccttgatggggcggaagccctgtgagcacatgaagatctggaaacgggggagttcaccagattccctc

SEQ ID NO: 464414 - DNA, 1211 bp, Homo sapiens
gttttaggggctcctcgtagaggcacatccacgtatgacacctgcctccgtgctcacccccagcccagaccccagagggaacgtggacagagctcccactcccttacctgccgctcaggtgcacgccccgcctgttcaccccgtactctccgtgcctgcgccctcatgtcctggcatgaaccctgctttcatgctcctacaccccctaccctgtgtgtgattccacctcctctcatggtggcaccaggcactctgggctgctccaactcacgttgctggagggatgagggcagtggctttggcatcctgcaggctgggttccaaatctccattctgcacccgtgtgaccttggacaatggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctggtaggaccagaaaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagtacaaagtctgggttgcttagtctgaccttcgaagccctctagagccccttccaactgccacagctgcattgtccacctctctcagagttgcccctgctggccgtcatggagctgtgttttgctttgttttgttttgttttgttttgttttgttttgttttgtgttgtgttgttctaacattcgtgtaccaagcactgttctaggtgctgtggcaatattccagcccagggaggcagactggggctgacccacagaaggggctcagtggacattggttgaatgaaactcacacgagtcctttgaggacaggtcattgatgccatttttcacaggggagcagagtgaggctcagagaagggcagacaagggccagcagcccgctgggcagagttgccccaggggtacccaccttggtggggcccttgatggggcggaagccctgtgagcacatgaagatctggaaacgggggagttcaccagattccctc

SEQ ID NO: 464415 - DNA, 871 bp, Homo sapiens
ttctcctggcttcagagtctgtgctgtcatcaagcatcccctgatggatgctcctgtcttccccagggaccctgctcaggttctcagagttttgtgtcctattttactcaagggtttttcttggccatggctgtggaggacacgctggctattgacagctagggtcatcatgctcaagagaggactatcttcatcacactgttttggccaggacttaaaaatttaccgctttcacgatgattcgccacccgctctgttctactctacacaagaaaactttctaggatcgcaccctcccaaacggcatgctaacagttgtttcttgatcgaagatatctgtgatcaaacaagttccagaaatgcaggattggaccgagcaaggcagcaaaccctgcaatttgcttttgaatcctacaacggagtacttggatggatggggtggttgcaggatgcctttgaaggatacttgtgaaggtggaaccaccgtggcttggaagcttcgcagatgtcgctgtctccaaggatcaattgcaaacacaatgacctgatgagcagagaaatcccatcttagaaaaaaagagagagctgagtctacagagccgctacttaggagtctgacttcataatcaattgtgaaatgtggaatataatagaaatttaaattctatctacattatgttagggttaataaaaaaaaagggcatatatgagtagtctttaaaaattccttctcgtgactccagttaaataggctgaaatgaattcgtttaatatgcctttccacattctatgttagccattttattctttgaattatcacatacacaacattcaatactatttttaaaataaatcctagaatcccacctca

SEQ ID NO: 464416 - DNA, 1094 bp, Homo sapiens
gaatgggaagccgtgtttctgcttgaggcagtaggaagcaggagaccaaaaaagttgtaggcaagtagttggacaaaaagcaagaagctgatcgatgttgctggctttggattctttgtgaacaaatgagacaaggctgcaaattcagaggatcctcccagaagataagatggagcaggtcaccaccttcttccctgcttcacaccctcaggccccgactcttgtctgctgagatcactctccaaaccaatcttcccttacaaagcccttgttgcaggctatgctttctgaggggaacccaggccaagacactaaaatgacacaccaacatgaagacatgaacacaattgcaaagggattggttggattgcatatctctgtgaatgggactcaagagaagtttgggaaatgctggaccagatgacccttgcaatcatggtgcacagaattaaaaccgtcaagttccccatccatctctgagatggatgagaatctgagtcttccacaagatgcccaagacttgttaaacccgtggaatgtctttgggtatgtgtgacatcaacaagaagcagcagacaaaacaaaatattttcacaaacattcagaaatccctaaatcttgtgagttgtcgtatcatttgtagatataattataaaatggcacatgatgctgacctattccaaggcaattgttcatctcatgtactcagtgctgcctctgactccattgtgatggttgattttatgtgtcaacttgactgggcccaggggtacccagatatttggtcaaacattattctgggtgtttctgtgagggcgttttggatcttcaacctgccaggcttcagattgaagtttataccatcagctctcttggttcttgggcctttggacccagactgtaagtgcaccatccgttctcttgggtcttgcttgctgactcaccctgcagatttggggacttatcagcctctaattctgtgagccaattccttctaatatatctctctatacgcatcctgtctcactggaagaaccctgatacggttaggctttgtgtcctcattcaaatctcatcttgaattgtaaatccca

SEQ ID NO: 464417 - DNA, 481 bp, Homo sapiens
gaatgggaagccgtgtttctgcttgaggcagtaggaagcaggagaccaaaaaagttgtaggcaagtagttggacaaaaagcaagaagctgatcgatgttgctggctttggattctttgtgaacaaatgagacaagctgccagagggatgctaacaccgcccacgtgctgcagcaggactttggaaggggaaccagcactgtaatgaagtgttgggttggctcaagtcttgtctggaccacaaaccatttttcaaccactagtgtgcctttaaaacccaaaccaactgtgagagtggttttctactttgattctagatgggaaaatattttgcttttttggtggatgacagtgtcaggtcccaaatggatttggtttcatcctccagcacgcatgcatataacgtgaaacatgcccacactctgcaagggccacagccaccccaccattatgttccaaggcaaatatgcgtccgcgggtccc

SEQ ID NO: 464418 - DNA, 1255 bp, Homo sapiens
  misc_feature (2)..(4): n is a, c, g, or t
  misc_feature (9)..(9): n is a, c, g, or t
  misc_feature (11)..(11): n is a, c, g, or t
  misc_feature (15)..(15): n is a, c, g, or t
tnnntgtangntganccagccttgcatcccagggatgaagcttacttgattgtcatgggtgagttttttgatgtgctgctggagggtcttacccagttgggtgaaacgggaaacaggacatgtttaacaaagtaccttgactgtcccttggtggagggggtgtgctttgctggggggaaacccactcaactaggctgcccatattcctcagaactaccaggaggaaaggataagtctcctggtccacagagtctgtggccacccatccccctaggggatcaggcccagagagattcaggttctgtccctgagcctctggctggagttacgggagttcttgcatggaagccccgcccagaagttgtgagtcccagtgctgaatgctgccccttccccaagaagctcagatggctgagacagcaggcagctgcagctgtggtgctggtcgcccctccccctgggagattggtaggcttaagcctattccagctgagaggctgttgataatctgcatggctccgtggcatgggtttcaaaatataaactataataatgtctggcaaacccatgttgcattattgctgccaggatcatattgctgtggggttgaggtacaacgtacatctcctcctctttggtgatttcactgataatgtggatttaaacatctttaacaaactgggaaaggtagtaaagctttatatagatggtacttctccccgtacctcctaaaatgttttcttgatactttttggagagagaaattgggcctgatgctgaaggagaactcttctgtccactgcaagtccacttacatgagcagctaaataaatgaatgggattctgaaggactgtatgtggagagcaaggttaaccatttgtgcttgctgcatgagtgaataagcaacgatgagtgttaggctgtttattcagataccctcacgccactgcagaagcgagtagaggaagaatacaaggaaaaaagtgtctcccagcctgtggaaagaggatggctatttcatccactaaaggtgtacactttaagtgaattggtatgtctacatcatcccaggaggagtgaatgtctgtgtgtgtgtacctgagataagatgatgtcttgtccaatgctggtttccaccttgtgccctgagctgttgggagaggctcctgcgacctgtgaccctgaagcagaataagtggactgaataaaggaatgatgcgtataaatgattgtaaaataaaaatttgtaaagta

SEQ ID NO: 464419 - DNA, 401 bp, Homo sapiens
tttttttgagacagagtttcgctctgtcacccaggctggagtgcagtggcgtgatctcggctcactgcaagctccgcctcccgggttcatgccattctcctgcctcagcctcccgagtaactgggaaaggtagtaaagctttatatagatggtacttctccccgtacctcctaaaatgttttcttgatactttttggagagagaaattgggcctgatgctgaaggagaactcttctgtccactgcaagtccacttacatgagcagctaaataaatgaatgggattctgaaggactgtatgtggagagcaaggttaaccatttgtgcttgctgcatgaggtgagaaaatgcgaaaagagaatgaggaaatttcagctgggtccctccctttaatttagggtt

SEQ ID NO: 464420 - DNA, 905 bp, Homo sapiens
cagatgggagttctaaccccagccctgccacttattcccaggtgacactgagtggaaattaggccaaaataaatactactttctgcttaaaaaaatgcagtgatgtccaaagagaagggaggaggaaggatgaaaggaaagacagaggaggaaggaagagaagaaagaagagtggccggcacaagggcttggagatccctgaagctgttttcctttctcctcacccccacagggagggatccacatcgttgtggggtttttgttgttgttgtttttgtttttgtttttttgcctcccttcatcaaagcattcattgtagtgtatggtaattgtctctgaatgtaacagcctctcttccctgaggcctgggtctgcttgtttcataccatcttctccttaacacacagtgcttggtaaacaatacctattaataaacatttgttgaatgaatgaatgagtgaatgaacgaatactgcactctttcgacttggttagagacatgtcttgtaggctggcatgtacttcacacagcactcttaggtagagtttgtatatgttattccattgaagggaaaaggaagccagactgtggggagaaaaaaaaaaaaaaaagacattctgaagaagtaaaaactacccttgtgggtttcaaaaatgtctgggctattatgcctgaagctgaaacatcagagtccactctgacaacagtacctagggggacgcagcaaatttcctgtagccctggcatgagcaacagaagcaaagacaatgacaactcaaagaggacaggacccaggggatctccagggacttcagtggaccaagaaatggaggaaggaagaagggaggaagagaaagaagctcttcagggaggagatttcggtgctgactagaagagcggccac

SEQ ID NO: 464421 - DNA, 1180 bp, Homo sapiens
  misc_feature (1)..(3): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (13)..(13): n is a, c, g, or t
nnncangncnttngtagggacatggatgaagctggaaaccatcattctgagcaagctatcacaaggacagaaaaccaaacaccgcatgttctcactcataggtgggaactgaacaatgaggacacttggacacaggatggggaacatcatacaccagggcctgttgtggggtggggggagggggtagggataacattaggagatatacctaatattccaaggattaggatggggacatgtctttggagccaccattcagcccgctacaggaaagatgtgtcaaaatctctccaggattgtcaatttctccttgtaattcaaaggaatggctgtatttcaaaggtttcctttcctcatatcttccctaaatctgaccagcggaagccacggcctggggtgttttctggttcagtcacaatttccagggtaggactgtattgtaagaagaatgcggtcactctccccaagcgcacattatcacacttcttttaagcaggagatcttaggactgtgtgagtggccagtcacatttccattttgccagaactaccattattcccacagcctctggaacaaaacctcttgctcgagaaggtgcttcagatgaactcactatttgaaaatgcatcttgttacgctgtttttttgttttttgttttgttataaataattaagttttgagggattctgcagatgcgccaaaaaacacgtgtccggggtaaaagctgtggaaggtgctcggttctaaggagagggaaggaaagccaagtggaccctgtcatctgaaattgttttgtcatccactgacttttacaaataaaacagccgggcgcagtggcttacgcctgtaatctcagcactttgggaggccaaggcgggcggatcacgaggtcaggagatcgagaccatcctggccaacacggtgaaaccccatctctacttaaaaaatacaaaaaattagccgggcgtggtggcgggcgcctgtagtaccagctactcgggaggctgaggcaggagaatggcgtgaacctgggaggcgcagcttgcagtgaaccgagattgcgccactgcactccagcctgggcgacagagcgagactccatctcaaaaaaataaataaataaaaataaaaaaataaaacaagctgtggcagagtaggttctgaaagggtcagagggga

SEQ ID NO: 464422 - DNA, 537 bp, Homo sapiens
gtggcacgactcaccaacacccctagagatccactggcaaaatttttgcttcctgttcccatgacattatattttgctggcctaaaggtcttagttccagagggagaaacactgccgccaggagacacaacaacgattccattcaattagaagttaagattgccacttggacactttgggcttctcctaccttgaagtcaacaggctaagaagagagttacttggctggggcgattgacccagattatcaagatgaaatcagtctactactccacaactgaggaagccaagcccactgctaactgatgagagaccagcttgaaagagggaggacctgccaattgccatcagcacaactccagatatatgggagtcaggtgatcataaaccatccattttctgctgagtcacagtagactgcaactccatgaatgagacaaggaggtgtcggtaaaaacaaaacaaaacaaaacaaagcaaaaactgcctggtgtaaccacagaatcttaagaaataataaatgattttaatccaatg

SEQ ID NO: 464423 - DNA, 1562 bp, Homo sapiens
agccggaagacgtgtatccctgaagattgagaaagaggccatccagaacctctgctagagcagtgaagaagggaaatatggggttggagtccccgacttgggcattgcctagtggatctgtgagaagagggccaccgttctgcagaccccagaatggtagatccactgatagcttgcatcatgcacctggaaaggctgcagacactcaacgccagcctgtgaaggcagctaggagggaggctgtaccctgcaaacccacaggggcagagctgcccaagaccatgggaacccacctcttgtatcagcatgacctgcatgttcgacttacagtgggtccagtcagtccccagactcatcctgtggtcatttccccagtgccagaatgcataattgacatagacatacttaacagctggcagaacccccacattgactccctgactggtagggtgaaagctattatggtgggaaaggccaaatggaagccatttgagccgcttcttcctataaaaatagtaaatcaaaaacaatatcgcatccctggagggattgcagagattagtgccaccatcaaggatttgaaagacgcaggggtggtgattctcaccacatcccaacaggagaaggctctgcaacaggtccaggctgctgtgcaagctgctctgccacttgggccatatgacccagaagatccaatggtgtttatggtgtttgaggtttcagttgcaggttcttcacaatattcaggcattacccaaaagtggacagctgcagcactacaatctttttctaggacatccctgaaggacagctatgaagggaaatcttcccagtgggcagaacttcgagcagtgcaccttgttgtgcactgtgcaaggaaggagaaatggccagatatgcgattatgtactgattcatgggcttcaaccaatggtttggctggatggtcaggaacttggaggaagcatgattggagaattggtgataaagaaatttggggaagaggaatgaaggtttgggtcactccaccaggaaaaaaacacacgacctgctgaggtgcctgttaaaggcaaagggaatacagaatgggtagtagaagaagcttgcttctgtttttcatttgtgtgaaatatcttttctcacccctttacctgcaataagcattgcaggagttttaatactttatatctttcaataaattggtaaatatcatctaacatcaaatttgtgggaatagccctgttcaatgaacacctggactatcctttaatgatgtctacatcaatggaagccaagcccactgctaactgatgagagaccagcttgaaagagggaggacctgccaattgccatcagcacaactccagatatatgggagtcaggctttagggcaaaaaccggggatcacagaatgcttgctcaatcaactttgctcatccaaaatcacaaaaatcgcctcaaaaaatgttgatgataatttaattttcttcactctccatgaagatgttagataatgctcactctgggtgagaataaaagccagactcatcaattgtgttacc

SEQ ID NO: 464424 - DNA, 2314 bp, Homo sapiens
ggcagaggaacgtggtgacatttcattatgatgtctaaacttagaacttctggagaatttggaaggatacattattcgagaatcatcctttggattcttcaaagccacaggatacattcaatgtcagtaaccatattcttgatccctgtaacatttattggcgtttcgcttaggtctctgataaatgtttgacgtctttgtgtgtcttcacactttgttatcctgaaactgtgtcatgtagacataaatggtcacagtttgtcttaaaagtctttaggaaaaggtgatactagcacttgggctagaaggtcgtgcagagcagaggaagaaaaaggcccactgctgtctacaaatgaatgggaagatttaagatctttcaaagcaagttgagtctagacccttgcccaagttttgtaacatgattttgtctctttccccccttttcatgcagattatccatggagttagcatgcagatagcatggagtttgtctgatagaagttgggctctggtggaagtacggaaattgaatggtcagggaaagatagaatgcaggtttcttagggagtctctattaggtttccagcctgccttcctgggagtggaagagagatgaggttgtgcccttcaaggaggagctttacagagataaagaaactaagccctagaagaggaactctgccagtctatttacaaagcctgcactgaaagctagaccatatactctttggagagggatgatgtgaccagctcatagactagggcctataccatgtaataggtactcaaacttttttaaaataaatgaatcaataaatgaatgtctttattgcctgagaagaaaacagaactgccagcagactatgggacaaacgactaaatgccctccagacgttccagagtcctctgcctctcaggcttcagttcttcctgaaggaatctggagctggaaagcaggaagcaatttgctgtggaattttttccatcacaggttcttggtcacaacaaccaaatctactctagctaattgggcaggaagatatttactaaaaggtgccagtttgcctacagggtctctggaagggctggagaacatggatgttgcccagccgggaataagcccccagagaaaaccccctgacatcccacgtgcctcttctgctggaatcaatgttgtcattcttgcccatcattcgatacctatcccactatggtctgatctcgtgagactcgttcactatcacgagaacagcacaggaaagacccgcccccagaattcaatcacctcgcactgggttcctctcacaacgtgtgggaattgtgggagttccaattcaaattgagatttgagtggggacacagcaaaaccttctctcaaacccagtatctctcagaccaggagctgaccttaaaattaaggcctttttatttattcatttttaaatattgcctctctcaagccttgcctggattctccacctcctcaaccccaggaagcaacaagctatcaaagacagaatttgcacaacaggacaaaggaaggctataagcttcttgaaggcagagattatatctcattcaatcttctatctcaagtatctactgcaaaaccaagcaaacggggctgataggggatgaaaggcaccctatctatttggtgcactgtccacagtgcctgaaacagagtggatgctcaaacccatttggtgagtggacggacgcattcaacaaagaggtatgaggagaccttgtgtcgccaggaccttcgtaaatgaatgaatgaaggaaggaaggaaaagaaggaaagaaggaaggaaggaaggaaggaggaaagagagggaaggaaggaactctcctgacttatctggctgctctttttttgtgtcctatcctggctctttctactttgcttgatgtctaattgtatttagagtattttagatgtgaaagttaggagtagaaatggcagattatcacatgtgattctaggtctggagaactgtcttattgcttgattacatgaccattctagagtctgcacatttttaatcaagtttacccttaagctgcctccttgcatagcttaagttcagcctaaaggtttgtctttatattgtgagctataacctaaatggaattgtaaagaaactgtagtctactgttgtaccaatcactgaattttggccaatcaaaggtgaccaagagttcaaactgtgtttaaataagggaaatgcagagctgtaaccaatatggctatttctgtgccttgcttccattttctgtatatcactttcccttttctgtccataaatca

SEQ ID NO: 464425 - DNA, 1869 bp, Homo sapiens
cctttttattgtatccaggcgctcagctgattggatgatacctgctcccattgggatctcactatgttacttgggctggtctcgaactcctggcttcaagtgatcctcccatctcaatctcccaaagtgctgtgactacaggtgtgagtcactgtgccaggcccaacctgaaaccttgactgcaactcacctcagagactgcgacacactggctatgccccaagtcatatgtggagagggcagcttttctcatccggcttgccaggctcttctaaattgaacatagacagaaggaaaagaaaggcatgttctgggagctcagagtcttttgttacacgtgtctcgaagggtactaatacatctccagtagctgtgattatgccatgaaatgtctctaataaaaattactttttgaaataactgtttttcacttgctcttttggaaacattattccaaaagattgtgtctctaattttatgatggaattcatttggaaacttaatttactttacaaaaattcttgttaaatatattttgatggaatccaataaagagaaatcaatactgtatgtatttatacatatatatgtatttcaataccattcaatctcctctagtctatgaaatagggatcatgtgaaaatcaatttaagcatttccaagtaagatttaataacctaacatgtcaaaaatgttttattaaattcagctataattcatctctaacaaaattacgcatgaagattgaagtctcttaacttgcagaagatttgtacaatcatttgcagaatgatttaagaagaaacaatgagtctctgttgatagtgacatttaggccataaatatttactcaagcaaggatatgtaaataatttaatgaataatttaatttttgagaaataaactttgggaatatttctaatgcaaaacaataattagagtaggcaggaagagttggtgaccataaaaatgtctctgaatcaggagtcagagtttctaacacaacgacctcaagcatctgactccaggttcttcagcttttggactcatggacctacaccaatggtttgccaggggttctcgggcccttggccacagactgaagcccgcactgttgacttccttacttttgaggttttggaacttggactggcttccttgctcctcctcagcttgcagattgcctattttggaacttcaccttgtgatcctaagcctacacttttcatctcccctgctggaacaccaaatcttaactgtctgcacacagaaaagcactgtcacaggaaccaaaaatcagtgacaagcagtgttaagatgttttgggtacttcagtcaacaagctgccatcttcaacatggggcatacagagcagttttcaagcctctatagaagtcatcttacagcgagtctgagccagtgaaatgcagttatagtgatatgtgtactcccaaggtagctgtcaatgctcctactcggaaatactcatatgttgcttctgacttgaagcagaggaactcacaacctaagaagccacaggcttgaagatggcagagcacaagatggcagaagtttggaatgaattactacttgaaagagaagctcttatttaccaagaaatatattttggaatttgcatgagtaagaaataaatccaattatgctaacattatcattgaaattagagacgtttctgttagagtagctgttgttaccatagctaatatagatgaagattatattgatttaccagcagccagattgaataggaaatttaggccagtgtaaatcttcacctttccaccctttttcaggtatccctgatctccctattttgctctaaacaacctttaatcaacagtaccttc

SEQ ID NO: 464426 - DNA, 649 bp, Homo sapiens
cgccataattatgcgcctacgaataacgtcatcccgtcaccaccgaaatttatctcttctgtgtgccaaattttccgactgcagaggaagaattaacaatggccaaggccaaggggaacaggcagaaagaagagtgtggcctcaaatgatttacaagcattaatcaggaaacatatggctgtcttgccaaacttgctggacatttacaaggttcatagcatagctcacagctgaagacctttcattctgttcctgttggagaatttttgtggaaaaaccttcaattgcagttactacgcagtgcgccatgggaagagacacttctttaaatgcacttctccagccaaaatctagtaaggtagcctgaaatatcaatgtatatgaagtcatgttaatcttaactcagcaacaaatgtttctattgttatagatataaaattattactttcattcaacatgttgaatatattctttgatatactgtaaaagccattcttacaacctaaaaaatattacctagtgaataaagcaatatacaaaaacatgtgcattctttacacacagtaatatactgacatttcattttaattcatcagtagatttaataaaaaactttttaatacaaaaaaaatccgccttcctggcccca

SEQ ID NO: 464427 - DNA, 1203 bp, Homo sapiens
aggccatttacattcaaggttaatattgacataatgttttttttttctttccctttcccttttcccctgtttctggggggtgtgactgtagggtcttttggctttgcttctatagacatatgcacttcttttggcaggttttatattgggctgtggaattcaacatacaagcccatagatggcacttacaggcaaaaactgtctgtggtcaatgtggctgggtatatagttgatccttgtttactagcagaggctctctgttacctcaggcaatgggttgattcaagtgtcactcggcttggagctgggaaaccacctcgggtccaagttctctacacagaatctctgtacagaaagagtagacagttcagcctgctgatccaggtgatctggtgctctgaatgtatgaaggcaatttggcacggcatgtttaccattttatttgcagtctaaaacactgcctgatctcttctgtgtgccaaattttccgactgcagaggaagaattaacaatggccaaggccaaggggaacaggcagaaagaagagtgtggcctcaaatgatttacaagcattaatcaggaaacatatggctgtcttgccaaacttgctggacatttacaaggttcatagcatagctcacagctgaagacctttcattctgttcctgttggagaatttttgtggaaaaaccttcaattgcagttactacgcagtgcgccatgggaagagacacttctttaaatgcacttctccagccaaaatctagtaaggtagcctgaaatatcaatgtatatgaagtcatgttaatcttaactcagcaacaaatgtttctattgttatagatataaaattattactttcattcaacatgttgaatatattctttgatatactgtaaaagccattcttacaacctaaaaaatattacctagtgaataaagcaatatacaaaaacatgtgcattctttacacacagtaatatactgacatttcattttaattcatcagtagatttaataaaaaactttttaaaaaatttaatctcttaaatatagttcaataaagccatctttacaagaacagaaagctacagttactatttatcacataaaacaacctttaaattcaacatatttaataaagtctaaattagatttttatagtcttttttatagtttattgttaacaagtattgcaacata

SEQ ID NO: 464428 - DNA, 1403 bp, Homo sapiens
acgtgaatgggccacaacatctaaaggaactggggcacctgggagttttcatttccattatttcacttggagccagtggttttcagagcggggggccagtggcaccacagagctgcctttgaatgaccttggatgagcgactattcacccccattatattctccatctgtcagatggagactgtgatgtaaaccccatgtggctgggaggactaaccaaggtccacatctccagggccgctcttagctcagagtctttctgagggaaactgcctggcaccagtccgtgatgaaggtgtcagcctattggaacctgccctctcagataggtaagatccaaagatgtcagccgcaagcttccagtccctggatgagaacttagagtagggccaagagagctctctcagggataaaaatagagttgctgtgaagatgaagtaaatgaagacatgctgagaactcagaacaacgcttggcaacagtaattgtttaatacgtgctattattaacaagtaatagtctttcccatcctggtattcggctccttgattttccagactcctcggactcagatcctcctcacccaacttcaaggaggaagacagaatggggcttagcaggtccattacacggatgcagcaactgggatctggggatggtcactagctgaggtcagaggtggaggctggcacccccaccccctcccgcagagcccagtggggtgaggtggagggtagggcttctcagggaatcactgtcctgccccttctgcgtgcccaggggacctgcgaacactctagacctggggggcccaagaagttcaaacctccctgaccttcgcggtacagggaaaaccaaagtctgagacgtttgcaggccccagggccaacccacctcatgcagaggctagaaggcctacaaccagagcccccctccagcccgtggtatacgggaaaccacgcaatggcacctatgggttccagtcctggtggtccctatgcacagctgcgctgccaggacctcgccacttcaactcccggggtgtccactttctcatctgaaaagtggggtggtcacctctggactgtcatgagaattaactttggcggtgcatggcgaggaaagtcaggcccaaagatacagggcgtaggcctgctgctgcctatcctgggccggctgaggtctgggcgccctgaagacagggagccagcagccaaaagagaacgtgctggggtccagcctgggtgccctgagctgtgccagctgcccctccagaaaacagacgctgcctgctgcctccagcggtgggctgcctgcgggttcccggtgaccctttccccctcctggagatgctctgcattgccccgctcgcacactccagttcccatcctcgtgttctaggac

SEQ ID NO: 464429 - DNA, 1810 bp, Homo sapiens
caaccgacatgtcgcgctccttctatgtcgactcgctcatcatcaacgacacctcacggcctgcgccctcgctgcctgaaccgcaccccgggccggatttcttcatcccgcttggcatgccgcccccattggtgatgtccgtgtccggccccggctgcccgtctcgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagagccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggaggctctgacgccagccaggtacccaatggcaagaggatgaggacggcgttcactagcacgcaactcctggagctggagagagaattctcttccaacatgtacctgtctcgactccggaggattgaaatcgccacttacctgaacctgtcggagaagcaggtgaaaatctggtttcagaaccgccgagtgaagcacaagaaggaggggaagggcacgcagaggaacagtcacgcgggctgcaagtgcgtcgggagccaggtgcactacgcgcgctccgaggatgaggactccctgtcgccggcctcagccaacgatgacaaggagatttcccccttatgagggagggcctcctccctcacatcccccgctcctggcagaccaggcaacgccaaggcgtggggcacccaggggccagaatccttgctcattgcagtggtcccatctggagaagaaacgaacctggaagttctggaatggacaagccgggacctgacccttcgcgtctccttcttgacctgtttatctaggactccaacttgaagttacagatttttttaaaaaatgtaaataacctataattcaactcattcttgtcgtataacagaggaaaaacagggttggtttaagtttaacactgtatggggtttttgaaagcacatgtcagttccccatccctactctctttcagaactcgataagaacacaggatttattgattattttctgttgtcgttttcaaacaaaaacacccaagttgaaaataatttagaaaattagaccttgtaggtcttgctttctgaaatttcgcctggggagaatttaaaatctaagtcgctggaagtccctttgtatgtgaataggtttatataaaatttatatttatatttatttaaataaatgaaacaaaaaccagaattttaaatctgtggtgtttgctctccctatcttctcctgccccctcctccaatgtctagagaaaggcatatgcaggaaaaagctgtctgaggaattcgaggaaaatgttgagtaagaacttggtaatgtgggtctcttgactgagggagtttgtggctcaatgggttttctatgtaacagaactttcgccaaggagacacctttagtcatgatggcatctaccaggcagtgcctctccatccttaaaataggcaacctcctcacagttgataggacaaatcactccatttggaatgacactgaccattaac

SEQ ID NO: 464430 - DNA, 1021 bp, Homo sapiens
caaccgacatgtcgcgctccttctatgtcgactcgctcatcatcaacgacacctcacggcctgcgccctcgctgcctgaaccgcaccccgggccggatttcttcatcccgcttggcatgccgcccccattggtgatgtccgtgtccggccccggctgcccgtctcgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagagccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggtagggcggggtcttggggcacctgcgctccgcgcctttcgcgctcctggagcaaactttccacctccagtggaggaagtgggagcccggggacagggtgaagagagaggacgggcttttagtgtaactgtagagtcagccacagaagttccacgaaagtggaagttagtttgccagcttctccactcagcctggtgcgttttactcctagtagtaggtgctcgagtattgccttattaatactggggccttagggacctcgaacgtcacggcggagaaaccagaggttaactgcttgggatttggggtgggtgtgtttgaacctgtgtggcatccccgcgtcggggcggctaaagcgtcttgacgtttttggctaagcctgcgcgcttctccgcttggctcaaagggaggcgatcagatagtgcaagcccccatccct

SEQ ID NO: 464431 - DNA, 892 bp, Homo sapiens
cactagggccaagatcaagatgcatgcatatctcgtatctagtgaaagcctgcttatcatttactgacggctgcctcctctttgtaccttcaaatggtgaactactaaaactgaacagtctgagaggaagtgatataaatcaggatgtaaattacatgagagaaaacaaaacaaaacagaagacttggcaaacaggggtgtgttacagctctggctgtggaagtcctgaggtctgggcccaaagaagggtcacagctcttcactactgtagtcttgtgaatggagatgtgtggctccaggcagctttttctctcctgttgctcatcttcgttgtgattgtcaatgaacaaaggactgtaccgatgcttaatcagttgcatattcttatcctctgtttctttaaccatattcttcagggcagctggacctcttggtggttacaacctgaagaggggttgtttcaaaatgaaccacttcagagcaaagcagggctgaaagctggagagagtaaagggaaagcgttctgatttcatcctacatctggatccattcatatccaatgttggaacgcaccttttcagccaaggatgatggcaagtgctcagggggctgaagcaggagaaaacttgagctcaagaatttgaggctgcagtaagccaaatggaaccactgcactccagtctaggtgacagtctaaaatgaaaagaataacccgtatcttgagattgtgagttattataaaattaaatattttggttaaaacttcacttggtagcaagtgatcaggcaagctgaattatttaaagaaagatgaaaattagagaaaataaaattctgaaaaatgttggcataatttttgtgaaaatgtaataaatcctttgcaatttttgta

SEQ ID NO: 464432 - DNA, 644 bp, Homo sapiens
atgatccccggcttcagaattcgcacgaggaaacctgaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagactcttcttttcatggtcaccctgggatatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaaca

SEQ ID NO: 464433 - DNA, 1742 bp, Homo sapiens
  misc_feature (869)..(869): n is a, c, g, or t
cctcccgggctccagcaatcctcccacctcagcctcccaaggagctgagactacaggtgtgagccaccatgcctggctaatttttatattttttacagagacagggtttcaccatcttgcccaggctggtctcaaactcctgggctcaagcagtcctcctgcctcagcctcccagagtattgggattataggtgtgagccactgccagattttggcagtgcacagccagagaacaacacatcacacacaggaaacagttgtgctcatgtgatgggggcctcagcactaggaaggagtggactattggcacacgcagcagcttgaataaatctgaaagtcactatgctgtgtaagagaagccaaatttaaaaagtgcatgctgtgtacagagggtgtcaagaatgcctcctacgtgacggaaagcagatccgtggttgcctgcagactggcaggagcagattccaaaggcacaggaagaagcttgtgggtagaatgtgttcattaccttctgtgcattataccataaaaaagctggtcacaaaaatgcaaaccaaaaacaaaggtgaaactaggataagatttctcacctgtgtgattggtaaacgtgcagatgtgccgtcatgctttgtttatgaagctgtgggatacaaggactctcatacgtcactgtggaatgcagaatattgcagcctcatggaagaggatttggcagcgtctaacaaaactacatggcatttgccctttgactcagcaattctagaatctgcctcaaaaaaactccagcaaagaaatgaaaggactttaggcacagagttcttttcacagcctgcatgtgtttgcaacaaagttcttcactgtggcgtttgtanatgtggggaaaagagagatcaggctggtactgtgtctgtgtagaaaaggaggacgtaagaaactccattttgatctgtaccccgagcgattgttttgccctgagatgctgttaatctgtaactttagccccagccttgagctcacagaaacctgtgttgtatggaatcaaggtttcagggatctagggctgtgcaggacgtgccttgttaagaaaatgcttacaggcagtacgcttggtaaaagttatcgccattctccattctcgataaaccaggggcacaatgcactgcggaaagccgcagggacctctgcccaggaaagccgggtaccatccaaggtttctccccactgagatatggccttgtgggatgggaaagacctgaccatccaccagcccgacacccgtgaaggatctgtgctgagtaggattagtaaaagaggaaggcctctgtctcctgccttcccctgggaacggaatgtctcagtataaaactgatcgtacatttgttcaattctgagataggagaaaaaccaccctgtggtgggaggcgagacatgttggccgcaatgctgctgttactctttactccactgaaatgtttgggtggagagaagcataaatctggcctacgtgcacatctagacatagtaccttcccttgaacttacttgtgacacagattcctttgctcacatgttttcttgctgaccttctccccactgtcaccctgttctcctgccacattcctcttgctgagatagtgaaaatagtaatcaataaatactgagggaactcagagaccggtgccagtgcgggtcctctgtatgctgagcgccagtcccctgggcccacttttctttctctataaaaaa

SEQ ID NO: 464434 - DNA, 1301 bp, Homo sapiens
tcatgctgccgtgttccgtgtgggaagcgtgttgcaagaaggttgtgggaaaatcagcaagctctacggagacctaaagcacctgaagacgttcgaccggggtcagcagacagtgggctctgtgcacactgttgggccctgccttctgcagggtgggctggtgtctgtcccgtcagtgctgacttagttccgtgcttgctgtctggatgggtcctggcccacagctataaagccacaaccagtgactccatggactagcaggcccaggctgacagctcggagggcccatgtgactgggtcccgcctgcccctgatggaactttttgtgtccccaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagcagtgtggagctcgttctcaccacagcccagcacccacacggccccgcccaggcctgcgggctggccttgctgatggtgaacagggaggagcaggccagatttaaatcaactcccgacagatttgaggcaccgctgaaaaaggcactctgacagcagttgggctttgggctggaaacagaatccagttcctgcaggtggttcagaggagccttaaggaagggttgctccgtggtgtgggtcagatggacgtcactaggcaggagcaagtgtccaaggcctggtggcaggggaggagatgattgtagacctagtgagaaagtcagcatctgtggggtggggacacagccactaccagaaaccagtcccacgtcaagggagcccagaagagacgcctcccctctcctcccacgggctgggccaactggaagcatctgcaggggagctgaggggatgtggtgcagtctttagcatcccctgggcactgagcaagcagagaagggcagaaatggaggtggggttgggatggtttactaggtgagtgtgtcctcgattattcaaatcaggggtccccaatccccaggccacagattgttaccagtccatggcctgttaggagccaggccgcacagtaggaggtgagcagtgggccggtgagctactgtgtgaactccaccccctgccagagcattactctgtgagctctgccccctgcagagcatt

SEQ ID NO: 464435 - DNA, 694 bp, Homo sapiens
acaacgcatttgtctcatcagtaggaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagtatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaacaaactttcttttatttccaaatccatttaaaatattttactgttatgactttagtcatatttgttgacctaaaaatcaaatgtagtaatc

SEQ ID NO: 464436 - DNA, 559 bp, Homo sapiens
gctctgttccactctacgaatctgccatcatttacagtcccctgttgcgcatgtagatcatttttgaatttgttattggaaaatactgcagcaaatacctttaagttcacatgctgtaaatctacttttatagttaaaatttttcaaaaggaacacaagagatggttttttgtacatttttgtgcttaacttaccactgactcttcttttcatggtcaccctgggatatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaaca

SEQ ID NO: 464437 - DNA, 648 bp, Homo sapiens
gctctgttccactctacgaatctgccatcatttacagtcccctgttgcgcatgtagatcatttttgaatttgttattggaaaatactgcagcaaatacctttaagttcacatgctgtaaatctacttttatagttaaaatttttcaaaaggaacacaagagatggttttttgtacatttttgtgcttaacttaccactgactcttcttttcatggtcaccctgggatatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaacaaactttcttttatttccaaatccatttaaaatattttactgttatgactttagtcatatttgttgacctaaaaatcaaatgtagtaatc

SEQ ID NO: 464438 - DNA, 989 bp, Homo sapiens
  misc_feature (360)..(360): n is a, c, g, or t
aagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatncacctgaggtcagatcaagaagctgtcacagatggcagaagaaaacctgaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagtatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaaca

SEQ ID NO: 464439 - DNA, 965 bp, Homo sapiens
  misc_feature (360)..(360): n is a, c, g, or t
aagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatncacctgaggtcagatcaagaagctgtcacagatggcagaagaaaacctgaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagtatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccagtggccagggagcgtggcacttacctttgtcccttgcttcattcttgtgagatgataaaactgggcacagctcttaaataaaatataaatgaaca

SEQ ID NO: 464440 - DNA, 1054 bp, Homo sapiens
  misc_feature (360)..(360): n is a, c, g, or t
aagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatncacctgaggtcagatcaagaagctgtcacagatggcagaagaaaacctgaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagtatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccagtggccagggagcgtggcacttacctttgtcccttgcttcattcttgtgagatgataaaactgggcacagctcttaaataaaatataaatgaacaaactttcttttatttccaaatccatttaaaatattttactgttatgactttagtcatatttgttgacctaaaaatcaaatgtagtaatc

SEQ ID NO: 464441 - DNA, 1105 bp, Homo sapiens
  misc_feature (360)..(360): n is a, c, g, or t
aagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatncacctgaggtcagatcaagaagctgtcacagatggcagaagaaaacctgaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagactcttcttttcatggtcaccctgggatatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaacaaactttcttttatttccaaatccatttaaaatattttactgttatgactttagtcatatttgttgacctaaaaatcaaatgtagtaatc

SEQ ID NO: 464442 - DNA, 1804 bp, Homo sapiens
  misc_feature (931)..(931): n is a, c, g, or t
cctcccgggctccagcaatcctcccacctcagcctcccaaggagctgagactacaggtgtgagccaccatgcctggctaatttttatattttttacagagacagggtttcaccatcttgcccaggctggtctcaaactcctgggctcaagcagtcctcctgcctcagcctcccagagtattgggattataggtgtgagccactgccagaaaaacttttcctaagacaaggcaggttttacattatatttagattttttttaatgatgtcttttttggcagtgcacagccagagaacaacacatcacacacaggaaacagttgtgctcatgtgatgggggcctcagcactaggaaggagtggactattggcacacgcagcagcttgaataaatctgaaagtcactatgctgtgtaagagaagccaaatttaaaaagtgcatgctgtgtacagagggtgtcaagaatgcctcctacgtgacggaaagcagatccgtggttgcctgcagactggcaggagcagattccaaaggcacaggaagaagcttgtgggtagaatgtgttcattaccttctgtgcattataccataaaaaagctggtcacaaaaatgcaaaccaaaaacaaaggtgaaactaggataagatttctcacctgtgtgattggtaaacgtgcagatgtgccgtcatgctttgtttatgaagctgtgggatacaaggactctcatacgtcactgtggaatgcagaatattgcagcctcatggaagaggatttggcagcgtctaacaaaactacatggcatttgccctttgactcagcaattctagaatctgcctcaaaaaaactccagcaaagaaatgaaaggactttaggcacagagttcttttcacagcctgcatgtgtttgcaacaaagttcttcactgtggcgtttgtanatgtggggaaaagagagatcaggctggtactgtgtctgtgtagaaaaggaggacgtaagaaactccattttgatctgtaccccgagcgattgttttgccctgagatgctgttaatctgtaactttagccccagccttgagctcacagaaacctgtgttgtatggaatcaaggtttcagggatctagggctgtgcaggacgtgccttgttaagaaaatgcttacaggcagtacgcttggtaaaagttatcgccattctccattctcgataaaccaggggcacaatgcactgcggaaagccgcagggacctctgcccaggaaagccgggtaccatccaaggtttctccccactgagatatggccttgtgggatgggaaagacctgaccatccaccagcccgacacccgtgaaggatctgtgctgagtaggattagtaaaagaggaaggcctctgtctcctgccttcccctgggaacggaatgtctcagtataaaactgatcgtacatttgttcaattctgagataggagaaaaaccaccctgtggtgggaggcgagacatgttggccgcaatgctgctgttactctttactccactgaaatgtttgggtggagagaagcataaatctggcctacgtgcacatctagacatagtaccttcccttgaacttacttgtgacacagattcctttgctcacatgttttcttgctgaccttctccccactgtcaccctgttctcctgccacattcctcttgctgagatagtgaaaatagtaatcaataaatactgagggaactcagagaccggtgccagtgcgggtcctctgtatgctgagcgccagtcccctgggcccacttttctttctctataaaaaa

SEQ ID NO: 464443 - DNA, 605 bp, Homo sapiens
acaacgcatttgtctcatcagtaggaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagtatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaaca

SEQ ID NO: 464444 - DNA, 2189 bp, Homo sapiens
  misc_feature (360)..(360): n is a, c, g, or t
  misc_feature (1316)..(1316): n is a, c, g, or t
aagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatncacctgaggtcagatcaagaagctgtcacagatggcagaagaaaacctgaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagttttggcagtgcacagccagagaacaacacatcacacacaggaaacagttgtgctcatgtgatgggggcctcagcactaggaaggagtggactattggcacacgcagcagcttgaataaatctgaaagtcactatgctgtgtaagagaagccaaatttaaaaagtgcatgctgtgtacagagggtgtcaagaatgcctcctacgtgacggaaagcagatccgtggttgcctgcagactggcaggagcagattccaaaggcacaggaagaagcttgtgggtagaatgtgttcattaccttctgtgcattataccataaaaaagctggtcacaaaaatgcaaaccaaaaacaaaggtgaaactaggataagatttctcacctgtgtgattggtaaacgtgcagatgtgccgtcatgctttgtttatgaagctgtgggatacaaggactctcatacgtcactgtggaatgcagaatattgcagcctcatggaagaggatttggcagcgtctaacaaaactacatggcatttgccctttgactcagcaattctagaatctgcctcaaaaaaactccagcaaagaaatgaaaggactttaggcacagagttcttttcacagcctgcatgtgtttgcaacaaagttcttcactgtggcgtttgtanatgtggggaaaagagagatcaggctggtactgtgtctgtgtagaaaaggaggacgtaagaaactccattttgatctgtaccccgagcgattgttttgccctgagatgctgttaatctgtaactttagccccagccttgagctcacagaaacctgtgttgtatggaatcaaggtttcagggatctagggctgtgcaggacgtgccttgttaagaaaatgcttacaggcagtacgcttggtaaaagttatcgccattctccattctcgataaaccaggggcacaatgcactgcggaaagccgcagggacctctgcccaggaaagccgggtaccatccaaggtttctccccactgagatatggccttgtgggatgggaaagacctgaccatccaccagcccgacacccgtgaaggatctgtgctgagtaggattagtaaaagaggaaggcctctgtctcctgccttcccctgggaacggaatgtctcagtataaaactgatcgtacatttgttcaattctgagataggagaaaaaccaccctgtggtgggaggcgagacatgttggccgcaatgctgctgttactctttactccactgaaatgtttgggtggagagaagcataaatctggcctacgtgcacatctagacatagtaccttcccttgaacttacttgtgacacagattcctttgctcacatgttttcttgctgaccttctccccactgtcaccctgttctcctgccacattcctcttgctgagatagtgaaaatagtaatcaataaatactgagggaactcagagaccggtgccagtgcgggtcctctgtatgctgagcgccagtcccctgggcccacttttctttctctataaaaaa

SEQ ID NO: 464445 - DNA, 1078 bp, Homo sapiens
  misc_feature (360)..(360): n is a, c, g, or t
aagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatncacctgaggtcagatcaagaagctgtcacagatggcagaagaaaacctgaggaatggtctggaacacggacctggtggagaccctggagctgcagaacctgatgctgtgtgcgctgcagaccatctacggagcagaggcgcggaaggagtcacggggcacgcacgccagggaaggctacaaggtgcagattgatgagtacgattactccaagcccatccaggggcaacagaagaagccctttgaggagcactggaggaagcacaccctgtcctatgtggacgttggcactgggaagtatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaacaaactttcttttatttccaaatccatttaaaatattttactgttatgactttagtcatatttgttgacctaaaaatcaaatgtagtaatc

SEQ ID NO: 464446 - DNA, 1062 bp, Homo sapiens
  misc_feature (360)..(360): n is a, c, g, or t
aagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatncacctgaggtcagatcaagaagctgtcacagatggcagaagaaaacctgaggaatggtctggaacacggacctggtggagaccctggagctgcagaacctgatgctgtgtgcgctgcagaccatctacggagcagaggcgcggaaggagtcacggggcacgcacgccagggaaggctacaagagcctgccctgtggtcacttgttcttcagatgaactgatttttgtgcagagcacacgtgttggattctgcctggtgcagattgatgagtacgattactccaagcccatccaggggcaacagaagaagccctttgaggagcactggaggaagcacaccctgtcctatgtggacgttggcactgggaagtatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaaca

SEQ ID NO: 464447 - DNA, 1024 bp, Homo sapiens
acagaggtgacagttgtacaacattgtgaatgggctaaatgccactgaattgtacactttaaaatggtaaattttatgttatgtgaatttgacctcaacaaagaataactactaaaagaaaagaaagtttccacaaatctatgagaataatgccaaccacccagtagaaaagtcaattaaagatatagatataaacagcagctcacagaaagggaaatacacatgaaatgttagcccacctcactcataatgaacacaagtcaggcatgactggaaacacgggctctaacaatgcccacaggacactgtgtcttcctcctgctctccattctgcctctgtatggtggcaggctctccctgtaagatggcaaagatggcccccaaaacccccaagcttacattctcacaggttggcaatcctggcaaggaaggcaaagtctctcccaggagttccagcaaaagttttggaatggtcagctggcccctgctggggcccctggctatccctgaaccaatcgctggagccaggggaaaggatgggaaatcagtctctcagccatcaggacctgtcacggagctgctgggcaatgctgccaaggtcctctggctttctaagaacattcccattactcagcccacatctccgcctgcattctgcccctgtggaggagacctctggttctgcaactgcctgggagagtctaagtcggtgatggagagttaactggcctggtggacacatacctaccatgtcctgcaatctagcttaaagcttacactttaagaaacagaataacaagaatagattctagagctgagtttaaaccctggctccaccactgataagctgtgtgaccttgggcaagttgttagctggcacccagacacattgagaagatggtcatctgaaagccaggaaaagagactgctccagaacctgaccatgctggcaccctaatctcagatttccaccctccagaactgtgagaaaatacatgtctgatttttaagcccccaagtatat

SEQ ID NO: 464448 - DNA, 713 bp, Homo sapiens
cctatatccctcctatggtcatgtcactggcagcacctccctgtggaaggagatacttctctcaccctttgacagacagcatgcgtggccatatggggctgctccttcaaactgtgccccagaatgagaagatatgtggaggagagctaaagccaaaatgtaacatgaacaataaacaaagctttgttattatgtattactccattttcacactgctgataaagacatacctaagactgggcaatttacaaaagaaagaggattattggacttacagttccacatggctgggaaggcttcacaatcaaggcggaaggcaaggaggagcaagtcacatcttacatggatggcagttggcaataaaagagcttgtgcagggcaactccacttttaaaacaagcagatctcataagacccattcactatcatgagaacagcatgagaaagatctgtccccataattcaatcatctcccaccaggttcctcccacaaaaggtgggaattatgggagctacaagatgagattttggtggggacacagagccaaaccatatcaccagagtgaaaaacagagttgatcccatgcttcatttcacagctgcctagctacagtgagtgatatatgtttctaacacaatggatggtggcttaggaagaggatccaataaaatctatgttggagccaagaataaaatccaaggaaaatgcctct

SEQ ID NO: 464449 - DNA, 1069 bp, Homo sapiens
gctagcgtgaacgactctcttaatcctccaccgctacagggctttgacctaaagcttggagttgagtttggaacaaaaatgtgtcgtgaggggggttgcatggactccttatcatacgccaaatctaagatgaagctgtggaattgagtcctcctccaacaagggaaagaaaaggataacttacacctgtaatcccagcgctttgggaggccgaggcgggcggatcacgagatgcccgtgagttgacaagttgtttaaacgcagatgttacaataagtcagtttaagatttggtgaagaaagtagataagagtatacacagaattgaagaccttagcatcactactattcgtctgcttaggaggagcgaacagaagagaatcagtgagtttaattctcatgcatacaaactggttgataattttttcatcagatcacatccagtatgattaatgtttctcttttttcatttggccaactatgaggtgggcgagtaataacagtatcgcaaaatagaagaatatatgaatattaatgaacagttcatactttgtctccccccaacccctcacatgataaagcaaataatctcatggttcaatctctagagtactaagtttatggctggagaaagcagtagtgcatggcatatgggcaaaaagcatctctgggtagctaaggcaggggtgccttgttacaattattcagactgaagtccagcatattgtatgtaatatgctatttaaataagaacaattttggtacagttattatcatacactatacacaatactacatgtaattatccttcaagtttcctgtgaatattctatattggaaatgttaaattctataattggaaggaacgtctgtaatttagttgaaataaaaagaaagtgtgttaactttattttaaattacctctacattgtcaaacaactagagagggagcatgtatgattaaacaaaattgtaatttaaatcatgtaaagtactaatcaattaaaataataaacatagatgcggccggaaattcttatattataataaataataataatatattctgt

SEQ ID NO: 464450 - DNA, 1390 bp, Homo sapiens
tatacaccatggaatactatgcagccataaaaagggtgagttcatgtcctttgcagtgacatggatgaagctggaaaccatcattctgagcaaactattacaaggacagaaaaccaaacaccacatgttctcactcataggtgggaaacgaacaatgagaacacttggacacaggaaggggaacactgaatcccaggtgccaccctggaacaggagaggccaggctcccccgcccccacccccgcacacaacgccagcttcccaaggctacatcccagtgcacactcctccctgcatgcaggctggtcagaggttcgctgtggacctctttattcttggttgtctcatttccccttctaaagaaggctttgacctaaagcttggagttgagtttggaacaaaaatgtgtcgtgaggggggttgcatggactccttatcatacgccaaatctaagatgaagctgtggaattgagtcctcctccaacaagggaaagaaaaggataacttacacctgtaatcccagcgctttgggaggccgaggcgggcggatcacgagatgcccgtgagttgacaagttgtttaaacgcagatgttacaataagtcagtttaagatttggtgaagaaagtagataagagtatacacagaattgaagaccttagcatcactactattcgtctgcttaggaggagcgaacagaagagaatcagtgagtttaattctcatgcatacaaactggttgataattttttcatcagatcacatccagtatgattaatgtttctcttttttcatttggccaactatgaggtgggcgagtaataacagtatcgcaaaatagaagaatatatgaatattaatgaacagttcatactttgtctccccccaacccctcacatgataaagcaaataatctcatggttcaatctctagagtactaagtttatggctggagaaagcagtagtgcatggcatatgggcaaaaagcatctctgggtagctaaggcaggggtgccttgttacaattattcagactgaagtccagcatattgtatgtaatatgctatttaaataagaacaattttggtacagttattatcatacactatacacaatactacatgtaattatccttcaagtttcctgtgaatattctatattggaaatgttaaattctataattggaaggaacgtctgtaatttagttgaaataaaaagaaagtgtgttaactttattttaaattacctctacattgtcaaacaactagagagggagcatgtatgattaaacaaaattgtaatttaaatcatgtaaagtactaatcaattaaaataataaacatagaacttgatgcaagaaagtttcctattaaataataaacctgggctgg

SEQ ID NO: 464451 - DNA, 2122 bp, Homo sapiens
ggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgtt

SEQ ID NO: 464452 - DNA, 762 bp, Homo sapiens
cactaaatggatgaatgaatgatgaaacctgctgctgaagggcccacctgcagacctgggctctccctgcactgcccgggccctcagggtagcaccacccaggctgggttgggccacacaccccaaaagggccctgccaaagccctcccaccccagacacagaaggggcctgcggccacccctgggcccagccccggcctccccgcgcatgcccccagccccccaccaatgccctcccctgcccctggtgggtcagagatctcctggaggctccagggagcggaggcgatgcccgcaggcgatgagcgtgttctcaggagcaggtgggcaggggccttgcagactcttcatttaggaagttattttcatgatccaaaggagcttgtaaaatacgagatttatagagcatacagaatctgcaaataaaatgattttttggttgcttttgttttacagatttaaaataagtagcattctcttaagttcatgttacttgagggaatgccacataattctagctatgtacttcttaggaatgtgaaaaagtagggaagtatgcttggtcacagtcctgatggtgactttcctatgccttaatagaaaagagcacatcagatctctcctaaggataaggtttgagagttaacaagatggcacaatcaaaagggcagtagacacttgtaacatgaatgcacaatatagtccattgctgaaattcttattctggaaacatatcacactaaatgtttactaaagcaaaat

SEQ ID NO: 464453 - DNA, 451 bp, Homo sapiens
cactaaatggatgaatgaatgatgaaacctgctgctgaagggcccacctgcagacctgggctctccctgcactgcccgggccctcagggtagcaccacccaggctgggttgggccacacaccccaaaagggccctgccaaagccctcccaccccagacacagaaggggcctgcggccacccctgggcccagccccggcctccccgcgcatgcccccagccccccaccaatgccctcccctgcccctggtgggtcagagatctcctggaggctccagggagcggaggcgatgcccgcaggcgatgagcgtgttctcaggagcaggtgggcaggggccttgcagactcttcatttcttccttcccttatcaccgttagccattttcatgggatagagatacagaggagctcccattacaaagcgccattaaactgtcatctgtgcaactgtga

SEQ ID NO: 464454 - DNA, 1565 bp, Homo sapiens
ggtcctgcctctgctggggccgtgagcaagcgtgggacggtgagcattgccaggagcatctgcggtgctttctgcaacttctctcccaccttgcctccttgcgctgaggctctctggcactttcagagaccagcagctgctgaaatgtcctgttctaagaggacctcccttctgggcacacttctacgtccccgctacccaaaactgcactggtgcactggaagagagccccacgttggtgttggcctgggcacctgttggatcaacacaataactgtaccctggagttcctggaagctgccttctgctcagccaggcctgcttgtgggcggagcccatgccagctacatgtgtcaaggaagccacagcttggctagtgagcaatgcaattctgggaatgttcaggctctctctgttctttcctctcttgcaaaccatgggcacccttgggtcccttggggtcactatgttacacctgctttttatctgtctgggcaagagctgctcaagccacaccttgtgacactgaggaggacagcacattgcactctcacctcctttgcagttaagtgtgaaatagtgccaatagagtgtaaaagaaaagaaagaagatgattcacctcccaaagattccccactgctgtgtcccttctatcaacttgatacaaaaaaacacaatggccccgggaaccacgtgttgaagatgagagagctaaaagatggaaagagactggagccctgagtcaccacctggaggaaaactacccacccatcaggaatttctactacacatttgggagtttttggggttacagcagctaatttaacgaaaacacccagagacaagagctattactgcacaaattggttaagttacctttttgtatgtttgggtcctctctattcgatgagactgcgcgttcctttgaagcaaatctgtttaaaattcttatatccccagagggcctagcagagagtatgcacagagtgagccttcagtaaatgctgagtaaataagctcctaatggatgaaactgtgtcttcgaagtttgttctgaccagtacttagtataggattttgtgctgttggtcacttttcataaaggttcttgctattaaggaacttgacatccaatgtactcatagaaagtagaaattcaggggaaacaaatagaagagatatgtccaaaaatccatttaaaatttcattgacagatatttatctctttaatcctggaagttgtttcatgtaagggaaggttcagtagaatgaaaacaggactgtaagctgggaggagatttggggtctcttggccaactctgccacaaattgtgttaccttcaacttccctgcctgtaaaatgaagtcagtggtccctaaaatgaaattggactaatggcaaattagctagcatttgattatacatcgatagtttccccatgtgattttaacgcacaaatcagattttggaaccattaggtaggtgatcttatcttatgagtttatctttttcaacatggaaaaataaatttgttttgctgaccgaaggctgtgtaacttagaa

SEQ ID NO: 464455 - DNA, 1798 bp, Homo sapiens
ggtcctgcctctgctggggccgtgagcaagcgtgggacggtgagcattgccaggagcatctgcggtgctttctgcaacttctctcccaccttgcctccttgcgctgaggctctctggcactttcagagaccagcagctgctgaaatgtcctgttctaagaggacctcccttctgggcacacttctacgtccccgctacccaaaactgcactggtgcactggaagagagccccacgttggtgttggcctgggcacctgttggatcaacacaataactgtaccctggagttcctggaagctgccttctgctcagccaggcctgcttgtgggcggagcccatgccagctacatgtgtcaaggaagccacagcttggctagtgagcaatgcaattctgggaatgttcaggctctctctgttctttcctctcttgcaaaccatgggcacccttgggtcccttggggtcactatgttacacctgctttttatctgtctgggcaagagctgctcaagccacaccttgtgacactgagatcagctatgaaaatacccagccggcctgcagccctcccggcagatgctgaaaaggaaacccgactgggagatgccgcccacccttatccccagagagctgcgttgtttcctcttgccttggcctttggatccggccatagcaagcatccctgggcacctggctgaagctggaaactcgggataagaatggaagccctggaagggaagaagaaccgaggagtgagcttgccctgaggacagcacattgcactctcacctcctttgcagttaagtgtgaaatagtgccaatagagtgtaaaagaaaagaaagaagatgattcacctcccaaagattccccactgctgtgtcccttctatcaacttgatacaaaaaaacacaatggccccgggaaccacgtgttgaagatgagagagctaaaagatggaaagagactggagccctgagtcaccacctggaggaaaactacccacccatcaggaatttctactacacatttgggagtttttggggttacagcagctaatttaacgaaaacacccagagacaagagctattactgcacaaattggttaagttacctttttgtatgtttgggtcctctctattcgatgagactgcgcgttcctttgaagcaaatctgtttaaaattcttatatccccagagggcctagcagagagtatgcacagagtgagccttcagtaaatgctgagtaaataagctcctaatggatgaaactgtgtcttcgaagtttgttctgaccagtacttagtataggattttgtgctgttggtcacttttcataaaggttcttgctattaaggaacttgacatccaatgtactcatagaaagtagaaattcaggggaaacaaatagaagagatatgtccaaaaatccatttaaaatttcattgacagatatttatctctttaatcctggaagttgtttcatgtaagggaaggttcagtagaatgaaaacaggactgtaagctgggaggagatttggggtctcttggccaactctgccacaaattgtgttaccttcaacttccctgcctgtaaaatgaagtcagtggtccctaaaatgaaattggactaatggcaaattagctagcatttgattatacatcgatagtttccccatgtgattttaacgcacaaatcagattttggaaccattaggtaggtgatcttatcttatgagtttatctttttcaacatggaaaaataaatttgttttgctgaccgaaggctgtgtaacttagaa

SEQ ID NO: 464456 - DNA, 2301 bp, Homo sapiens
gggcgcctaagcacatagttagatgaacttgcccggtagggagtgtctggtgaaggggagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagta

SEQ ID NO: 464457 - DNA, 1244 bp, Homo sapiens
gggcgcctaagcacatagttagatgaacttgcccggtagggagtgtctggtgaaggggagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagagaacccaccaaaccaccagccagtatctttgccagaagtctttctgccacagatattgaagttttctgggcctccccactggagaagaatagaggacgaatacaaggttatgaggttaaatattggagacatgaagacaaagaaga

SEQ ID NO: 464458 - DNA, 857 bp, Homo sapiens
gaggcatgtttctaagctgatatagtcagtgtccatgggatggacccggcaggtggcaagacaaactatgcaaaaggatcgtgatggaaccctcaaatatgaaggtgaaaagaactgcacaggcagcgaagtctggccctgtcacccaggctggagtagacggggtttcaccatgttagccaggatggtctcgatctgctgacctcgtgatccgcatgcctctgcctcccaaagggctgggattacaggcgtgaaccacagtgcccggcctgaaatcttgaaataaatgaaaaacgagctaatcgctgaacaaaaaaataaaaaatcactgtggaatgacaagaacattctacaaacatttatatgtgatttttgcaaaaagtgttaatgccaatgtgtatatgctgagtgatgaggagataaatgatcctgaatcagaggagcaaatcgtgacactgagaaaataaatgcaaaagctgaacaaaaaaaaaaaaaaaaaaacaaaaattttggggcggtggggcaaaaaaatttagaccccttggtggcgccgcgcccccattggttattgaacggccataccggcccaagagaaactgggcctagaactggggcggttcctaccccaataaaaagctgcgggcaccgacgggtctgcaacaacccaggggttcgacgcactagggctctaccgggggccaggagcggatgaagccagcacgcgtaggggacgagaacggggcgcgagacggcgccgtgcataaagcagttactaaccaaacccacgcgcaacacaaacagagaacgaagatacactgcgcacatgcatacagcacatggacgcaccacaacagtgt

SEQ ID NO: 464459 - DNA, 1209 bp, Homo sapiens
gaggcatgtttctaagctgatatagtcagtgtccatgggatggacccggcaggtggcaagacaaactatgcaaaaggatcgtgatggaaccctcaaatatgaaggtgaaaagaactgcacaggcagcgaagtctggccctgtcacccaggctggagtgtaggtgcatgatcttggctcactgcaatctctgcctcatgggttctcacattctcctgcctcagcctcccgagtagctgggactagaggcacccaccaccatgcttggctaattttttgtattttttcatagagacggggtttcaccatgttagccaggatggtctcgatctgctgacctcgtgatccgcatgcctctgcctcccaaagggctgggattacaggcgtgaaccacagtgcccggcctgaaatcttgaaataaatgaaaaacgagctaatcgctgaacaaaaaaataaaaaatcactgtggaatgacaagaacattctacaaacatttatatgtgatttttgcaaaaagtgttaatgccaatgtgtatatgctgagtgatgaggagataaatgatcctgaatcagaggagcaaatcgtgacactgagaaaataaatgcaaaagctgaacgtagaatgctacaccatgtgttacacagcacagtttcagaggaagggggatattaagagtgcagatggaattaatgttactcatcagctgtccttgaaacaagattatcctggagtacctgggaactgggaggactttggactggaagaaagaagacaatatgacaaccgctctcaaatatttgccggactcaacagggagctggatccatccatcaccagggaatctttactacggaacactctcctacctatgaagaaagaggtagctctgtctctacaaaaacaaacaaacaaaattaagccatgcagggtagtgtgtgcctacatcagagagccacttaggattaagaacgcaagctgcccccaatatgcatcctctgtccttaaagacctgagctatgaacatggaaaagattgaaaaacactgccttcagtattcagttgctgcgtttgatgaatcataaaatggtgtaaaacttcaattaatgttctttttaaataaaatatttatgaatgcatccagaaaaatgcttatgatttgggtattcacaaagtattcaagaatagaatgtattctgacttggaatgtgca

SEQ ID NO: 464460 - DNA, 1048 bp, Homo sapiens
gaggcatgtttctaagctgatatagtcagtgtccatgggatggacccggcaggtggcaagacaaactatgcaaaaggatcgtgatggaaccctcaaatatgaaggtgaaaagaactgcacaggcagcgaagacggggtttcaccatgttagccaggatggtctcgatctgctgacctcgtgatccgcatgcctctgcctcccaaagggctgggattacaggcgtgaaccacagtgcccggcctgaaatcttgaaataaatgaaaaacgagctaatcgctgaacaaaaaaataaaaaatcactgtggaatgacaagaacattctacaaacatttatatgtgatttttgcaaaaagtgttaatgccaatgtgtatatgctgagtgatgaggagataaatgatcctgaatcagaggagcaaatcgtgacactgagaaaataaatgcaaaagctgaacgtagaatgctacaccatgtgttacacagcacagtttcagaggaagggggatattaagagtgcagatggaattaatgttactcatcagctgtccttgaaacaagattatcctggagtacctgggaactgggaggactttggactggaagaaagaagacaatatgacaaccgctctcaaatatttgccggactcaacagggagctggatccatccatcaccagggaatctttactacggaacactctcctacctatgaagaaagaggtagctctgtctctacaaaaacaaacaaacaaaattaagccatgcagggtagtgtgtgcctacatcagagagccacttaggattaagaacgcaagctgcccccaatatgcatcctctgtccttaaagacctgagctatgaacatggaaaagattgaaaaacactgccttcagtattcagttgctgcgtttgatgaatcataaaatggtgtaaaacttcaattaatgttctttttaaataaaatatttatgaatgcatccagaaaaatgcttatgatttgggtattcacaaagtattcaagaatagaatgtattctgacttggaatgtgca

SEQ ID NO: 464461 - DNA, 1368 bp, Homo sapiens
gcacacttaaacaaccagatctcacaaaaattcactcaagtatcatcaagacaataccaaggaggatggtgctaagccattcattagaaactgcacctatgatccaatcacctcttacccagccccacgtccagcactggggattgcatttcagcatgagacgtggattagttgcaaatgtaaatccccagggagctcctgccccatcaactgagaaggggcagggctcccgcttgtctccagctcttgccatctccatggagtgtgcagccccaggtgcacctcctcacggcctgaggagggagttccaggtcctcgctgggcccctctctgcccactcctccatgcctgaccacactgctctcccttcagtgggagacttggccagccccattgtggtggcccctagggtggcaggctccagggggctcctagggttgggctccagagactgtctacctcctccccacatcctcctcacactgtcagcagtgtgataaaaataaaaacagcatacatgagcacacacattgtcactttatatttatatcactttatatttatatcaaaactctaaaaataagggaaaatgtttaaagcatcctgagaaaaatgaatgaatgatacattttagaaaacaacaagatgaataactatgacttcttatccgaaacaatggagtcaagaggacaatggattgagatctttacagttctgaagcaaaattgacaagttttaattctgtacccagaaaattaaatttcaaatatttaagcaaaattactatatttacagataagcaaaagcagagaatctgctgctggtggacttgcactataataaagacaattcttcaagctgaaggataatagcaccagatggaagcttataaatgccagaacaaatgaagatcattggaaacactgtgcactctaatgaagaggacgaccatcccagacagaggaggaccagtctttgttctaggatttctttttcctaatgacttgctcatttgccaaactggcactaatgcaagaactctgtgattaactgatgttattgaagactgctttagactgactgactgtcagcatgcctccaaaattcatatgttgaaagctaatccccaataagatggtatttggaggtggggcctttggaagatgattaggtcatggggataaaagggactagtagcttctaaaagaggctccaaagagttgccttgctctttcctccatgtaaggacacagtgagaagacaattgtctatgaagcaagcagtgggccctcacagacaccaaacctgctgatatcttgatttatgacctccataactgtaaaaaataaatgtttactgttcaagcca

SEQ ID NO: 464462 - DNA, 1495 bp, Homo sapiens
gcacacttaaacaaccagatctcacaaaaattcactcaagtatcatcaagacaataccaaggaggatggtgctaagccattcattagaaactgcacctatgatccaatcacctcttacccagccccacgtccagcactggggattgcatttcagcatgagacgtggattagttgcaaatgtaaatccccagggagctcctgccccatcaactgagaaggggcagggctcccgcttgtctccagctcttgccatctccatggagtgtgcagccccaggtgcacctcctcacggcctgaggagggagttccaggtcctcgctgggcccctctctgcccactcctccatgcctgaccacactgctctcccttcagtgggagacttggccagccccattgtggtggcccctagggtggcaggctccagggggctcctagggttgggctccagagactgtctacctcctccccacatcctcctcacactgtcagcagtgtgataaaaataaaaacagcatacatgagcacacacattgtcactttatatttatatcactttatatttatatcaaaactctaaaaataagggaaaatgtttaaagcatcctgagaaaaatgaatgaatgatacattttagaaaacaacaagatgaataactatgacttcttatccgaaacaatggagtcaagaggacaatggattgagatctttacagttctgaagcaaaattgacaagttttaattctgtacccagaaaattaaatttcaaatatttaagcaaaattactatatttacagataagcaaaagcagagaatctgctgctggtggacttgcactataataaagacaattcttcaagctgaaggataatagcaccagatggaagcttataaatgccagaacaaatgaagatcattggaaacaggatgtgaggccaatctggctgggacatctgccaccccatggatctccagggttgattcggctgatctggctggctaggctggtgtccccttcctccctcaccactccttgtgtgtctgtcccgaagctgtgcactctaatgaagaggacgaccatcccagacagaggaggaccagtctttgttctaggatttctttttcctaatgacttgctcatttgccaaactggcactaatgcaagaactctgtgattaactgatgttattgaagactgctttagactgactgactgtcagcatgcctccaaaattcatatgttgaaagctaatccccaataagatggtatttggaggtggggcctttggaagatgattaggtcatggggataaaagggactagtagcttctaaaagaggctccaaagagttgccttgctctttcctccatgtaaggacacagtgagaagacaattgtctatgaagcaagcagtgggccctcacagacaccaaacctgctgatatcttgatttatgacctccataactgtaaaaaataaatgtttactgttcaagcca

SEQ ID NO: 464463 - DNA, 724 bp, Homo sapiens
atttcactgccaagtgccagaagaatgaggtatgtgaaattaccccagagaccaaccagacatttaagtagtaaactcatacacatccaagacttgtccaataaggaacaatggaggaacctactaaaaatttctgcaggccctctaactgtcctctgttgtttacagactaacaccacatctacagacactgaccctagatcacacctccaggagacaggagacaacatcttaacacttttcaccatgcatcctcctcttgaatcagagtggactatttgtaactttcgccagatacggaggtgtgtcagacagaccccttcaaggaagaatgtgctgcccagctttgaggaatgtcactgtcagatggcctccacctgttctctccttcagcaactgcctcagtgttcaagctgaggtcctgctcatttcagaacagccccagccaataagcatgcaaggccaaagtcaaggaagtgatgcaaaggcctagccatgtccgtccgctgcggccccctctggcagataacctttgctcctgagttcccactggcctagtagagactgtcaagcctgcatcacagtctgataattcctctttcttcccctttcctttcatggatataactccccaataatctttcttttttaaattgaggtaaaaatacacctaatataaaacttaccatcttaatcatttttaagtgtacagtttggtagtgtt

SEQ ID NO: 464464 - DNA, 897 bp, Homo sapiens
ggggtgtacaccccctgtgaaattaggagtatcatctcgccagaatattacgaataatgtcacagggtgttatcttctgtgacaataggagtatagacccctgggaaattatgaatactatcacaggggttaacatcccacaaaagtataatgaatactttcccaaggtgtacaccctctgtgacattaaaagtaacatttccctagaatatgccgatgatatcacagagcgtacatcctctgtgatacgagaagtgacatctgataaggatcatgcgagtaatttgacaaggtgtacaaaccctggggtaaaaattgatgtgaaccttggagacttaagggaagggggtatttgctgccatagtcagcaaacagcatcccaagagaagaagggaggccacagcagtgacaagaggccgtttactttcatggaattcgtgggagcaggtgaaattaacgaggttctaccaatgatgaaaccaggcccagaattgaaagggaagtgctgtttatcgagttctgtcacaagcacggcatttggattgtctgaatgaatcctcaaagtgacactttgaaataaatacctgtactgtgattttccacagaattcaactcagaaagtgcatcacctgaagactggttggatgagaaaactgaggtccgaagcggaagacccaggctttcagcacccagagattgtgcagaggaagagagagagagacaccactggtgcccccaccttgggacgtgcctaaagatcatgcggtagcccctacccccacccccaggtttctggtttataaaggacctccatgtcttcaatctcccctgagactcacaagagtcctgagaaaaggtaaaatgaagactcatttgagaaagaaaattaggcccagc

SEQ ID NO: 464465 - DNA, 2089 bp, Homo sapiens
gctagtccgaggggggaaaggggtgggaggggccctcggaggggcccctacaagggatcccagtccgcagaattaaaaattcgttcgcaagggagcgcccttccggggtcagggtcgtgaagagacactcgagaattagggtcctggactgcagtggggccgggcctggacttcgggcaggtgtttcctggccgccctggggccctgcagcaccgagggccgcgctgatctcagggctcaggcggacgaggggccgccacaggcaccttaggaccctggcggcctgaaggcctggggccttcaggaaagcctcgggcactcccagcgggggacctagcgccaggtcacgattccattcggggcggggagcttctaagcaggagttgctgaccaaggaaagagtctggacccgggacctcatccctgaggaccagaccacgaccttggagctcagctctcagtccttcccggctagggatgcggaggggtcgggagctcgacggctaagcggcagggaatcctgagttcctagagatctacagaaagcagaagaacgacactagatgagactagacagtgacggcggaaggacggaaccacatggagactgacacactttgcgagttgggactcaattgcatttctttaagtccttgattccgaagtttccccgccctcctatgcaagagcgtttggggaaactaagttccttagactctttcatccttgttatgtgagctcagggaggaaggcagacaatagctgcagcctaaacacctgctatctctcaatgcaataagatatagacggtgattggagtcgtttctctttttgcttccagagggagctcaaacctgaagcatcaaggttatctttttccaaaggatttgtgtgaacctaagttcggtacctgcgacgagtaaaaacacttatttgaccctctagagactcagctagaactgactgagcaaagggaaatcaggcaaaagaaagggaaggtactgaggagaaaacggcagatgttgttatctcccgctgagaggcgcggccggcggggccggatcctccgcttcccgcgactgccggagtcgcgctggactaggctgaccgcgcagggcggcgaggctggaagggaggtctccgcccgacaatgcgcaggtgccagaggagccaggaggagtgagaagcgccctagacccgcggcctcaagcgccatgcacgtcaaggggaagtgactccggagttgtgccaggaagaacaccaagaacgagctgtgcgtttttgcgcagagaagtagtcttcgcaagaccgcagctccctgccgaaggcccagaaagggagtgcgggggagagggcaaactagtgagtttggctggcagtgctcccccgacacaccccactttcttttcctgccactccagactccttcccggcagcgggcctccagaaccccttgttggtaaaggcgaggtgctgtggggatgcaggatatggaattagggaattcgggacggaaacactgcgcccagggactagaagagcaagtgggagtgagcagccgatatctgggggctgggatggcccccgggggaggaggcacccgactgggcctcagcttcaagatccggattctggggcctggaacgcaagtcaaccctgaatgtgcagccaaaccgatctcggagcggtaccttctcatcgcctttttggggaactacactaaagatctagtgtgcactgaacaggtctgtgggaaccaggaaggcagaggaaggaagggaggctcccgggagcccaggccccggcaaggcccttacagttcccagacccgccaaaccgaaagagagaccctggagagggctgagcccctgtgggcctggctggaggcctcgggtaggatgctgaggcaagagccacagcggtccgagtccaagaaccacgtccagactcagcttaaggttccgaggtgaaaggcctggcctagaagggagggagagagatctgaagaagagggggtgggtgaaagaaacgtggacactacaactgcgttttctgctcctgcagctgagcgtgcctggacaagtatgta

SEQ ID NO: 464466 - DNA, 863 bp, Homo sapiens
cattcctggtgcgcaccccttcgaaactcccagaaccccttcagatgtggaaatttggaacacccaccctttgccggcatccagtggcgactgtgagtgtacgtttggctggggaagtggccaggattcttgagcgccaacgttgcactggcccttcacgcgcctccaccatcctcactacggtccagggaccatcagaagcagcccagatccaacaagatcagggccaatggaggcaggacttcacccaaggcagggaccaagatggattggttctgcagtgtcccgggactccgtgggctacagaaggctccaccttgaggacaggcttgctgagtgaacgcctgctggtgacagcctcaagaagaaagtacattaagccaccttcttcccaggaaagagagaaaagcgtcaagtccgtggggtgaggagatggtgcctcagatgaggaggctgagtcccagggtacactcagaccaggaaggcaggcatctcagcagtgacaagaacaggctaaaggacaagagccctactccaatattctgagtttgtgagaaccccaggattttaccacccagggtgcaacagaagtgaccacgtgccagttctgagtctgggcctcaggtggccttggagctcccacttgttctcttggaaccttcgccaggccccatgtgagcatgactagggtggcctgctgggatcagacaccatgtggaggacaccatctcagaggccatcctagactagcagagcacaaaatgagagcgcagccggacaagaacctcccccaaccctgctgtcttatagattcatgagcaacaataaatgtctgtcgttcaaagtatcaagctttggggtgg

SEQ ID NO: 464467 - DNA, 415 bp, Homo sapiens
gagtaggcattgtgtgatagagtgatggcaaaatgtctgtgtatccctgccccttgccttgtgactttacacctcccatcgagaggtggagtctattcccccagcccttgcatctggtctggcctagtgactttctttggctaatagggtgcaacagaagtgaccacgtgccagttctgagtctgggcctcaggtggccttggagctcccacttgttctcttggaaccttcgccaggccccatgtgagcatgactagggtggcctgctgggatcagacaccatgtggaggacaccatctcagaggccatcctagactagcagagcacaaaatgagagcgcagccggacaagaacctcccccaaccctgctgtcttatagattcatgagcaacaataaatgtctgtcgttcaaagt

SEQ ID NO: 464468 - DNA, 876 bp, Homo sapiens
gcatagattgtctttccacactatgtggttgctgccaagggatgagggaggactccaagagagggttcttggatcttgcacaagaaagaattcaggaatggattgggatgatgaatattctcataattcttttgacctacattgtttgttaaactcatttcctggagacttggagtttgagcagatcttcagtgacattgatgaaaagattgaacaaaatgctgcaagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttggacaaagtcgaattcttatcgcagctcataaaatcctttatgaaactggaaaaaggtgttcaagaattgtttgacgaaatacttttatcactcaagataaccagggatacttcaggattagatgcttcagatttcgatatgttataatgttatatagggttgtgagaattaaatgacagtgaaaataaaatacctaagaaaatgtctagtatatcataaacgatcaataaatgtgagttgttaaaatagtaattataattatggaatatgttgtttttagtttagtcttaacaaaacccctttgaaaaaagccatgctgtgtgtactgaataatatttccaacattaaaggtaaaattcaaaggtataatggttgag

SEQ ID NO: 464469 - DNA, 2124 bp, Homo sapiens
tctctcacaacaggcgttggtcccagatggaatatgtgtcaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaagggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggaggctcatacatagaaagagatgtgactcccgccatcatggaggatgacgagttggccctagacttagaagacttgctgagcttttcttaccaggtggcaaagggcatggctttcctcgcctccaagaatttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtgcaaacagtattgtacaagtgtgttgcacaacttga

SEQ ID NO: 464470 - DNA, 1020 bp, Homo sapiens
ctgattcctttgcagtcctctcatgtggagtcagcctgttctcaatctgtccttccatgttcctcagagttgctctcagcatgctggcccccagcaccagtcccagctgcctatgtcaaagcttctctccctcttgagtctcaggtcctccaactacacggacctccaccccgccgctgctttccctaaccaccacctgattagtactcactctcatgatagtctgatgatgacagtggtatctggtccacagtcttcccttcatcccatatcaccaccccaggtgacatcacggtcatctacagtggccaacctacaccatttccagacttctcagggtcctagcttctcatctcccctctgcatgcagcactcaccattcatcattcaacaaatagttaccagtacctactactcactgaaggcccaacaacatctctcatctcacatgctctcctgcaatgtgaccatgccctagtcacatcaagaagtagtgtctacatcccagctcttaaatctgggaaggctggtgactgtttctatcaatagaatatgccagtttcatctataaaatggagattacaaataagaaagaaaaataaaattaaaatggaaaaatagaatatggctgggaacagcagctcacacctataatcccagcattttgggaggccaaggtgggaggatcacttgaggccagaagttcaagaccagcctaggaaacataatgagaccttcatctctacttttgaatgaacctggacaccctccaccggtaacacaactactctgagaccaccaagctggggtggccacacggaggcattctggttgtcagactccactgaactccctgccaacagtcagcatcaactcaccagctaggttgatcaagtcaccttggaaatgcatcctccagctccaatctcatgactatttctgttgccatgagaagcagaaacaagccatgtccattgagccctgcccaaaagaaaataattgtgtacaaaataactgatc

SEQ ID NO: 464471 - DNA, 2947 bp, Homo sapiens
gctgtctgaagtaggctaagaaaccatcatgctcatgactccaggccactttctgtctgacaggattcaggatgccctgtgtgccctagagggttcccaggctctggaacccaaaggtggtgagggatctgaaggagtagaggctgagggtccagggacagaaacagagacagtcctgcctgtctccacactgaacttctgcccagagatacagattgacatagcagacaaggagatagaacaaggagaagttaccacctctgttacagctttgctggaggggctggaaaagacctgctcctcacggccctcatgcttagagaaggatctcaccaatgatgtgacctaccttgatcctagtctgctaccagttcactcagccatcttcagctttgaacccctaagcagtccagatggcccagttgtcatccagaaccttcatatcactggcaccattacagcccaagagctcagtggcaccggattgcaaccatgcacacgctatactgtgaagtgtgagacatcccttgatggtgaaaacagcagcctgcagcagctggcctaccacactgtgaatcaccgctattgggagttcttgaatctgcaggccatcaggagaagaaaccagatctatgaaagttcattaaaaataatagagaagatggtggtgagtgccattgtggacaacttgaagacagcatttccttgctctgaatcccagggcccaacagaggagctgagtgaggccgagactgaaagcaagtcccaaacagaaggcaagaaggctaggaagtccaggctgaggttctcatccagtaaaatttcgccagcattaagtgtgactgaagcacaagacacgattctttattgtctccaggaaggcaatgtggagtccaagaccctatccatgtctgggatggaatcttttattgaaaaacagacaaagttactggaggtgcagccaacagaagccccagaaaaagatcctgaacaacttcccaaaggacatgtggacagttgcttgtcagatgcagctgtgccagcccaagatcccagcaacagcgattcaggaacagagacagagttagctgacacagccctgaatctgcttctcttgctactaacagaacagtggaaatggctgtgtattgaaaacatgcagaagtttcttcggcagaggatccttgggaaggaaagtgacacactggtgcacaaccagtatggtgcccaccatctcagttcaggtccaaggggagagtgggtatggctgtgcgagctggccactggttctgtgttctcaggaaattctctaatcatcactgattgtgttgccctggctagcaagcgcaaaggggctccccaaccgtttagcactcggcaggtgtaacgggtccatcctttttctgctattcggactgcggtttcagtagttaggagcattagcacctatttttattagtttttagaccaaagaaagccaaacaccattttatatttgacaatgcttcctgtatgattttataccagataagctaaatttcacctttatattagtgtgccattaatgttaaactcaattttaataaaaccttgtaggcatatttatccaattttaatgtctgaccataagttaaacattatgtaaacgaaagtacagaaccctggcaaaattgaaaggccccaatattattggaactcttttatgattcagcttttcatggagttctactttatcatgaaatctagcacactggttcctttcaattaatccctgaaggttaatatttttggaccacagttgacctgaggtaactgaaactgctgaaaacaaaaccatggataagggagaactcttgtattatcacagattatatcaaaactatggctctaggctttttagaagagtttaacaagtggagcttgaagctctgtttttaccctttctccgggctgttattgtcatacaaattacatctttatacatgttgtgctgaacaacaagtggatttgtaggtgtttctttgtgaagttatcttctaaatcagaattagggaagaaattattcaagatagactcctagaaatacaattatcagctcgtgagtacggacataatttgataaatacagcaaattgctttctaaaagttgttcagtaatttttgaccaaatagagcttccatgttttcaaatttttttgtcttatttatttagccattctgatgtatataaataaatattgcattaaaattcaatacgtatatgaataattattaatacagttaagcaaactttcatatgcttattgagcatttgaatatctccttttgtaaagggcttatcaagtttttgcccatttatccattagtctgcttttttcttactgatttatgagcagacttttagtattttcaatataaagtttaaaaggaggaatatcttgggggctgcttatatgcttagtaaatttctttttccaaattatgagctgcattttcactctcataatgtctttaatgatgattatgtattttaatgaagtctagcttgtcattttttcttttaagtttaaaataatttgccatatttaagaaatccttgcatatacaaaagtcatgaaaacattctcctatgtctcctatatcatcttctaaaagctttatttttatttatatagagatatatattattctgaattatttttgtgaattttgtgaatttagagccaagcttttttgtagttgtttgttcaaggtaggagtataattgccaagcatcatatttttgtttcttctcttcattatcctatttctcatagatcaggtaactatatactttctttttgttcccagaatctctaatgtgtttcactagcatgtttcttttttctttaccaatacaagatttcaatatatagtcttttgtttaacttttatttttatttcaggg

SEQ ID NO: 464472 - DNA, 2866 bp, Homo sapiens
  misc_feature (2035)..(2035): n is a, c, g, or t
aggactcagcactgggggacgatcatagagaatatatggcacaacaggacgataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaattcaaatgttctaagggcctttactaagaatggaaaaaatcctgtgttcatctttcatctgtgaccaatttcatattcatctatctcatttaaatgtgtcatcattttagagatcgtatcctggcagtgtgatgggcaagtggaccatcaattctggtgctactttttccttttttactcaggcaggttcctaggatttttctgggacaaatttctcttcctagagaaattcctaggggatttctaaaggatttttctaagggaaaaagggtgacatctttcaaaggtgtcatttattcccttgaaaggtgtttgaatcccagatcaacattttcagacatcctgatcttgggcaaattgcttaatctctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgctttttttttttttttttgggggaaacaaattttacctttgtgcccccaacatgtggggagtgtgcgcaagtggtgtgcgcaactccctcgggctctcccatgtggcggggtctccggcctctcccaaggtgtccacgtgctcttttccccttgcgccttcaagcctctccccgagatgtggcttgggcacatctgggaggcgccactttgcgccaaccaacgcgcccagcgtatatattttgggggcttatatttgggggtacaagcacgatagtggggtnttccgcccgtgtgtttgggcgcccggggatagtgactactcttgcggaactctctcgtgtgacaccctctgcgtgtgatactccacaccgcggcttctgcggccctcctcgcgcgggagattttggctgcgcggacatttgggccgagcgccgtgtgaaagtctcaccgcggggcgccccagggctgggcgttttattgcggcttttctctatatatccccccctgtgtgtggcgccacatttcccgcgttgtgactttaaaaggggtctcccccacacagtatggtgtggccgccatatttctcactgttgggaggaaacacctcccccccttttttttctttttctttctcgcggagagagagcgtagcgcgggattctccgcctctctgtgttgtgtcgtgccccccagagggcggtgggagcatcacacccggcgtggtgtatatcaggatcttctctgcgggcccccccatcagttgagcccgcctctttgtcgcgccctcccgggggggttgtttcaacagacagggcattatttccctgcgccgagcgcctgctgtttgccgcccccccacccgaagagttgtcgtcgtggcgcgggactatatcagcgcgcgagcccccccacgaaccgcatagtgtgtggccccccgacggtcaattcactcttgcgtggggcagccccttttatcgagctccgacacacgccggccggggggtatttctccccacacatgattgtttggcgcgcccgccgagggttggtgtgcctccaccaacggcctccttgctctagacccgcctgaaggatgttgtgtcttgtccacg

SEQ ID NO: 464473 - DNA, 1546 bp, Homo sapiens
  misc_feature (715)..(715): n is a, c, g, or t
aacaacggctaagtcgagccgcggttgtatttcggcaggctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgctttttttttttttttttgggggaaacaaattttacctttgtgcccccaacatgtggggagtgtgcgcaagtggtgtgcgcaactccctcgggctctcccatgtggcggggtctccggcctctcccaaggtgtccacgtgctcttttccccttgcgccttcaagcctctccccgagatgtggcttgggcacatctgggaggcgccactttgcgccaaccaacgcgcccagcgtatatattttgggggcttatatttgggggtacaagcacgatagtggggtnttccgcccgtgtgtttgggcgcccggggatagtgactactcttgcggaactctctcgtgtgacaccctctgcgtgtgatactccacaccgcggcttctgcggccctcctcgcgcgggagattttggctgcgcggacatttgggccgagcgccgtgtgaaagtctcaccgcggggcgccccagggctgggcgttttattgcggcttttctctatatatccccccctgtgtgtggcgccacatttcccgcgttgtgactttaaaaggggtctcccccacacagtatggtgtggccgccatatttctcactgttgggaggaaacacctcccccccttttttttctttttctttctcgcggagagagagcgtagcgcgggattctccgcctctctgtgttgtgtcgtgccccccagagggcggtgggagcatcacacccggcgtggtgtatatcaggatcttctctgcgggcccccccatcagttgagcccgcctctttgtcgcgccctcccgggggggttgtttcaacagacagggcattatttccctgcgccgagcgcctgctgtttgccgcccccccacccgaagagttgtcgtcgtggcgcgggactatatcagcgcgcgagcccccccacgaaccgcatagtgtgtggccccccgacggtcaattcactcttgcgtggggcagccccttttatcgagctccgacacacgccggccggggggtatttctccccacacatgattgtttggcgcgcccgccgagggttggtgtgcctccaccaacggcctccttgctctagacccgcctgaaggatgttgtgtcttgtccacg

SEQ ID NO: 464474 - DNA, 3177 bp, Homo sapiens
gataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggcgggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcgtgagtgtcagtctgaattcttcctcaaggtagaagttgagaggccccatttggtcctttcattttccagtttgtctccaagttaatactctgtgcttaaaatcgtgtatgtaaatagttgttatctgagaggtaatgtattgaattgaaggtacaatatgatcagtaaggaataagataagctgatttcccattcagcttcttttagtgaaacaattatatctttggcttatgtttttcccctagaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaattcaaatgttctaagggcctttactaagaatggaaaaaatcctgtgttcatctttcatctgtgaccaatttcatattcatctatctcatttaaatgtgtcatcattttagagatcgtatcctggcagtgtgatgggcaagtggaccatcaattctggtgctactttttccttttttactcaggcaggttcctaggatttttctgggacaaatttctcttcctagagaaattcctaggggatttctaaaggatttttctaagggaaaaagggtgacatctttcaaaggtgtcatttattcccttgaaaggtgtttgaatcccagatcaacattttcagacatcctgatcttgggcaaattgcttaatctctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgctttttttttttttttttttgtgagacagagtcttactctgttgcccag

SEQ ID NO: 464475 - DNA, 1390 bp, Homo sapiens
gatgtgctcatctattaccacaatgaatattaaaacctattccaaagaggactacggctccaccgctgttcagtcatttttagcatcacttgatggagagaagctggaactcttaaaaaatgacctaatttccattaaagacatctttgcagccaaagaattagagaatgaagaaaatcaagaagaacaagcaagcagtggtttacataggtactcacttatccaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgtggggaaaaaatcatttgttcccacagggtatcttgatcaggaaggcttctcccccagacatccgcgcggcttcctccctcgcttcttgaaggtgtttattcaaaaaccaccttctaaataaaccacctttcccaccttcgtatttttttctcttcaggacataccactgtctaacatcctttatatcctaccgatttttctgttatctgccttgcacgaggatgtagattccaggaaaggagggatttttctgtgttctgtttgttaccatattcctaacacccacagcagtgcttggcaaatagtcggtgctcaataatgatttgttgaattaacaaataggtcaaagtcttctgtgtataatctgtaaacgctgaatgagagaacggaaatagctgtactatagggtaatttgtgggaaaatatctggttgagttacattaggaaatgttaactgtgaagtaatggtgctcattttaatggtatttggtggtatagcattaatgattatgattggggagcttagaaatgagtaagctttttcccagtaaaattaatacgatgtactctttttttactttgaagaatttgctgtttgaggggtctttcaagattcttcagggtaaggtagactgcagtgaaaattcagaagccctgaagaagttaatggtggtgcaccaatactctggaatattatgcaacagtaaaaacaaatgaaaagaatggaatagatccctgtagtgacagctccaagatgtgtaattgagtgaaaaaaaaaagaagctgtagtatg

SEQ ID NO: 464476 - DNA, 1082 bp, Homo sapiens
agcggagaggtttcagcaacaccagtggcctacaaagaaggagccttcctcctctccccagactccagactctaaagggcgacctcctcctgctcctgctcctggagcgcagctagcgcacagcgtttccgcaggaatcttgagaatggcaaggcccgcatacccgcggtggttcccaggcccgccccctctcgcagctgcagccccacctgccagtgcgtgccgcctccgagcgacttccgggagccgggcggccaccgcggtgcaggcgcgcgcccaacggctttgcgaggctcactcggtctgagaggtcggaggctgcgagtgtcgctgctgaaggctgtggtggaccgggctggatcgcggattttggattagataatagatttgggatcgccgattgggggttggattgcggatttggggttggataggggatttggggctgggtcggcgggggcaggggcggggaggtgaaaaggtgacagggagctgcctcctctcaagagcagttggttgggagtctgagaagtcaccaccatgaagttgttcggcttcaggagccacaggggccagacggtcctgggcaccatagaccacctgtacacgggttccgggtaccgaatccggtactcggaactgcagaagatccacaaggcagctgtcaagggcgacgccgcggagatggagcgctgtctggcgcgcaggagcggagacctggacgccctggacaagcagcacagcagtgtgtccccaagaaagtgtcagagcctttacgtggaccttcccatggaaaaggaaacagaatagtcaatggaaaaggagaaggacctcctgcaaaacatccttccttgaagcctagcactgaaatggaagatcctgctgtgaaaggagcagtacaaagaaagaatgtacagacattgagagcagaaaaagccttaccagtggcttcagaggaagagcaacaaaggcgtgaaagaagtgaaaagaagcaaccacagctaattttagaacatgcactctgacagaaaagacatctgagaaacaaaacaagcaaatttgttttcctttttgcacctgcc

SEQ ID NO: 464477 - DNA, 901 bp, Homo sapiens
ggtttatatacattataggaggtgcctaatgagagaactcattcccctgtcaaaaataccaactgctctacatttggcctgtgccagtggccatgtgaaagtggtcactctcctggttaacagaaaatgccagattgatatctgtgacaaagaaaatagaacacctttgatacaggaggagtcttgtgccgttattctgctggaagatggcaccattccaaaccttaagggtatctacggcaacactgctctccattatgctgtgtatagtgagagcacctcactggcagaaaaactgcttttccatggtgcaaatattgaagcactggacaagcaactcgtggcagccattgatgtttactctgtcttcatagttttacttttttcagaagagtcacatagttggaataatactgtggatatatttttgaatattaagaaaattaaagctccatggcaattgaaggacctcctgcaaaacatccttccttgaagcctagcactgaaatggaagatcctgctgtgaaaggagcagtacaaagaaagaatgtacagacattgagagcagttcatttgaactaaaacagtgaatttgtcaacagaaaaagccttaccagtggcttcagaggaagagcaacaaaggcgtgaaagaagtgaaaagaagcaaccacaggtcaaagaaggaaataatacatacaaaagtgaaaaaatacaactatcagaaaatatatgtcatagtacatcttcttctgctgctgacagattaacccaacaaagaaagattgggaaaacataacctcagcaatttcccaagaaactgaaggaagagcatgatagatgcaccttaaaacaagaaaatgaagaaaaaacaaatgttaatatgctgtacaaaaaaaaaaaa

SEQ ID NO: 464478 - DNA, 996 bp, Homo sapiens
gagcaactggcgcaggcgcgctgctcggttgctgtagaaatggacctctacccgcccagatgttaccattcatcgcgaagggtgtcgtgaagatgaatgccctgtcgaacatcatccagcaggaggtcaaggaattttaactgaatgattgaatagtcttgcaagatctatgaaacaagcttcggctgctgtagagaaacaaaaatgggttcctgcaattctaaataagatgtactgggtgctctgagagttaataagctaaaaaattcaatgtttgttacaattatagtgtaaacagaaagcatttctgatacaatattattttactagattcagaaaagtatgagccatggtccctaccactaaaaaaactacaacccagaactacaggactaatacacatgaaacactaggaggtatccaaaatcatacttagtaaaatgcaaaattatattaacacaagagctccgagaaaatggagatcagtgaagaatgaaggggccctgcggctactcagactcctagatctgtatcagaggcacgggcctggcagccttcactgcacttgggctctgaaagacgttctcactcttgcaagtcacctgggaaagccagaatcgatactgtatggtttaacatttgaaactgacttgcagcacaagtctggacttatgtggaattctgggagacgttttgaagctattgatgaagtggtgaatccaacagaaatagatacacatgcaaagcagtgtgtattggacatgaatcaccataggggtgtctcatcctcatcattccttcttactaaaaacaaattatgtttatttcccttaagaagactatgattaattatacacaattacacttgcctttaattgaacagatttcttctttactctggattagtgggttattgtatattattaaatagcttcagaaaacccaaagaaggaaacctttctcttcagaactaaagctgggtaagtaatggtggtc

SEQ ID NO: 464479 - DNA, 574 bp, Homo sapiens
actctagaggatcgttgtctcttgaaaatagctttaaatgcttctccatccagttcttcagagagctactatcaacagattgagttgacaggaaaaagtcataatccaggccaaagtgagcaaactcccaagagcattcctggtcagcaccgcagcaaatccgtggcaagtgcaggtaattcattctcatgacagtgtccagagagtagggctaaaatgaaaacagcggtgagtgatgtggtgctgcttcacctttttcactggggaaatatgaatataagagaaagtaatttgtgcagaagtaaaatggaggtgtctttagtttgtgaaaatccctggtgcccctagtcattcctctataccatgaaactcccacagttactatgccctaaagaaacattatttggactggctaaacataggactgaaaaagaaaaagaaaaaaaaggcaaacagtgaagggtgaaggaaccatagcctcaagattgcagaataacaaaatcaatagctaaactttttttaatcttggaaacaaatcacttttcctaaattaggactaaagttcaaaataaag

SEQ ID NO: 464480 - DNA, 1120 bp, Homo sapiens
agatcatagagcaccttgaaagatgtgggctttcattctgagcccctctgctgcaggtctgctagagtttgctggaggtctactccgaccctgtttgcctgggtatcaccagtggaggctgcagaccagcaaagattgctgcttgttccttcctctggaagcttcatcccagaggggcacccaccagatgccagccaaacctcttctagccagcaggtgggaatgtttaagtctgccgaagctgcgtccacatctgcccctgcccctaggtgctctgttccagggaaatgggagttttatctataagcccctgactggggctgctccctttctttcagagatgccctgtccagagaggaggaatctagaaaggcaatctggccacagcgactttgctacactgcagtgtgggctgcatgtggtgaattcctcccaaagtctacagtatgaaaagggagaaaagagtaactttgcagtggaaagacctgacaaacactacctcagccaggccaatggctggcatcagtaattaatcaaacaacttttttttttttttttttgctgagcttgaaaatagctttaaatgcttctccatccagttcttcagagagctactatcaacagattgagttgacaggaaaaagtcataatccaggccaaagtgagcaaactcccaagagcattcctggtcagcaccgcagcaaatccgtggcaagtgcaggtaattcattctcatgacagtgtccagagagtagggctaaaatgaaaacagcggtgagtgatgtggtgctgcttcacctttttcactggggaaatatgaatataagagaaagtaatttgtgcagaagtaaaatggaggtgtctttagtttgtgaaaatccctggtgcccctagtcattcctctataccatgaaactcccacagttactatgccctaaagaaacattatttggactggctaaacataggactgaaaaagaaaaagaaaaaaaaggcaaacagtgaagggtgaaggaaccatagcctcaagattgcagaataacaaaatcaatagctaaactttttttaatcttggaaacaaatcacttttcctaaattaggactaaagttcaaaataaag

SEQ ID NO: 464481 - DNA, 998 bp, Homo sapiens
aaaaggaagtatggacagaaaacagacagctgcctggacacgcttcccatcccattgtgggccccgagcctattttacaatgaaatggtccatagagcagaccgggctgcctctcatgatgccccaggacaacatagatgatgccttctgcaaagactacttccactggtgctacctggtaccccagcacgggatgtgcagccacaagttctacggcaagcagtgctgcaagacttgctctaagtccaacttgagggcccctcgagccatcaggagtgaccaacttcctgggtggaggtcaggggagctccaggaggctgcccaggctcctcctcctcctccccagcggccgagcatctcttaccaggaacctggagccaccgccggagccagcgtcatctctagggtcactggccaggggactgcattctggtttgggactttgcctatggaaatgggaaaaatgaaattcctgctaaggtgcttctatctctttcagattcatgcattgaaggagagattttttatactttatgttttatctttctcagttatttgcaagtgagtgtccttttaaaaacacacttcttcatgcttttctttgtaaatgacagatcgaagtataggttacatcaaaaccctaccatcctgagaagagttatggttctattatagcagacgtcagccacacagcctatgtgacaataaccttagagtcctgtgttttgtttttgtgtgttgtgagattttaatcttttttttttcggtgagtctggccatttctataatgccaggtgggaagccaggctgcgggtgttagggtgggaatctgcccggcgtctctggcaccctccctgccatcctcagtgcggctgctgttctcctgtccggtgctgtggctccattccaaaggggcacctggatatttatatttgctgaagttttataataaagtttatatggtacagtgtgcttctgaactacctcatgattcttca

SEQ ID NO: 464482 - DNA, 857 bp, Homo sapiens
gcatctgggagactgggtagagcatgcacctcaaagctatcctgcctaatggaccagggagctggggtatttataccccactcccatcagtcactggttcagggctgctcccaggaagagctaattctccagcatttctggcctgctatttggaagggcagagtggctctagggccagagagagacctcaggaaagggatgcagggcaggcagtggtagtcaggcagatgtgcactgaaggggtcaggttcagttctaaagaccactggcccatctggactgtcctggacattctgtctgcagcctgtctattcagcaggtgcaagaaactgctaccaatccaccccagcctcttcttgaatgttgactgctagatcaaccctgtggacagccaattcccagatggaccatccccatagaagtggttcccaaacctggctgcccactggaatcatgaggaggatgtggagagcttttagaaaatgcccatgcttgttctgcccacagagatggttcctggagagcccacacctctctcttctcctgtcctcaaggaaaggcccaaccaccctgatgtgtgaccttggccaagacctcctctcactcccagcttcagtcttcttatccagaaaacaggaaatctggactcttcaatgtcacagtccctttcggctttcatattcaggagttttcaggctttgttaaaagcaaaatgcccaggcccatcccctgtagattcaggatgtggtgcaggctcaggccaggtttgggacttctgcaggtttcaacatcatccctgaggagttgtctgatgcctattaaagtgcaccctctatgacagtgtgtaccgaacatgg

SEQ ID NO: 464483 - DNA, 818 bp, Homo sapiens
taattaaacagacataaattaataatgttttctaggactatacttactgtcagaccacctcagaaaatagtatcacctaaacaagaacatgaagataggaaacatgacaaagtcactgataaaggaagtgaaagtgggacttcctgtaatgagctctccacttccagttgtgacagccattcagaggcaagcactccccaggacaacccatccagtgcccagcaggcaacagctcaccaacctaacactttaacattggatcgcccctctaaaaaagcacctgtacaatggatacccccaccagacaaacgcagaaacagtgaactctttcagaccctcatcagcaagtcccgggaaacaaatctgtccaaaaagaaagtctgtgagaagctaagtgtggaagaagaaatgaaaaagtgtattcaggattttaaaaaaatccacattccagattattttccagagcgcaaacgccaatggcaatctgaactgttgcagaagtatggacaaagcctataaatgtaagctgtctaggagattgaattttctttgttctggatctgtgacttttttgtgtatgtgtatggtgtttatgtatattaagatggtgtaaatatgccttatactgttatttatggcatcaacattcatttactaatgctagtcatgattattactgtgaaatgagtcttacatcgggctgtgaaaattggtataatgatgctttgaaagatcctattatcatgttaatcaaaataatagagggaaatggtaaagagctttatgtatttattaaaaaaagaaaaatgtattagaat

SEQ ID NO: 464484 - DNA, 1565 bp, Homo sapiens
cagccattttctttggtaacagtgaactggaaaaggggaaataactaggttttgttttttttttttttttttttgaggatgcttggacacaggatctgagttggcacagatattcagggttccaaagtgataatatgcagaatgtggggactagaaaacaaatggagtcttcacctagatccaggtaccagtgaagctactaggtccattattccacctgatgaacacttctctagcattctaatgtataattagcataaacacacatggcagttgatgggaccttcatctaaagttcttgacctataagacagagattaaaaaacaaacaaacaaagcaaaacaaagtagagtacatgccagagggaacggcagagattactgtcaccctcagtaactaaaaaaatgcaggggtggccactataatatcccacctaatttatcagtctgaccctgaaaaatataaatattttttaaaaagggatcattctttcttttaaaaatatctacaaaaacctataacttctagctatggacactgatggccatcctccccattctggtatcttttcagcagtgccccattatgacaagaacagcacaggaaagacctgcccccatgattcaatcatctcccaccaggtccctaccacagcacgtgggaattatgggagctacaagatgagatttgagtggggacacagagccaaaccatatcagagatacagtgtcagaattgagttggaggacacccagctggtggctgctgtagagatgatggcttgcctgcttattggtggggagaagtcctcacacatttggtcacagaggtcttctgtgttgattgctatggggcgagagcagagaaaaaacagtttgtgtgtatttccactcactcaacttgtatctgaagagaggaacatttacatcggcatagtcatttaaacgctatcttactggtttttcactttaaaaattaacctgtagataaggcatgaagacagttataaggaataactgatataatctaggaggtattttgcaggaagagaggaacccaggcaggctgtggctagaatagggaaatatggagataggatctaaataaactgaaataaaaatgtagaggttttaatatattttcaaaaattactacaataaaggaaggtaaaataataacataactatctaatgtgttcacctgcagggaacagaagcgaaagtacagtggtatgaaatgagatatagccttcttttctctatcagggaatcagatgtttttgaaagtacgtgagcgtcaaatgatcacataaactcattcttgggatttttaaataattgcataaaattcttgaaataacttgtaactgcttgtgtttaaaatattttcatgacatcaacaaatttgagcaaacattctgagtaaagataattaattgtacttgaaatgtcagactgagacccagggtcaaatttgcaaaattttttaaaaaagtaattattctctagtgccataaaatatttagttttaatattgctaaaatctatgttatgtctattacgtt

SEQ ID NO: 464485 - DNA, 1013 bp, Homo sapiens
gcaggcgggaatggaggctgcgcatggtgctcgcgggccaacacaagttccgggtgggtgtgggctctgtgggccccgcactgggggcagccgggctggccgcggcagccaggccagcagctgcagagggtgcaccaggtcccccagcagtgctggcccgccggcactgtgctcgaattctcgctgggcctcagctgcctccccgcagggcagagcttgggacctgcagcctgccatgcctgagcctccccaccgctgggggctgctgcccagcggagcctccccgacaagcgctgccccctgctctgtggcacccggtcccactgacgcccaaaggctgaggagtgggggcacatggcgggggactggctggcagctccgtctgtgccccgccagcgaggctacgaacccaccagaagtaagaaactctgaacgtgtatgaacatcagaaggaacaaactctggacacatcaccttgaagaactgtaacactcaccgcgagggtccacgtcctcatttttgagaatcccagtgtgctcatcccatctgtgactcctggtcaccgacacataaagtgtagcacactgccaagcagcacctaactttcagatttcatggtgaacttgtccgtgtgggaaaaggagtcctcgcaactactgaggatgctattgcttactttggaggcaagaaattattctaaacctaattaatccaccgcatcataaaaacttacaccgttgctgtctgaatttgtctagaagagactgctgcacaagtattttctaagaatcgcttgagaacctgctaagatacttccaggcccagataatttaggttgtaatgcaagattaagaaactgatgtacaggagaaaaacccaggcaatcagccataatttggctacactttttaagaaaatgttatctagatatatttctcattagagcttaccatgctttaatgtatctcaataaagtctccatgaatacctaaaatgttacaattcacagcctt

SEQ ID NO: 464486 - DNA, 1438 bp, Homo sapiens
ttacccagaaggaaaacaagagctattttctaaacatctgaaatcttgcgcgaggcgcggggagcctaggacctggagcgagagccgcctacctgcagccgccgcccacggcacggcagccatcatggcgttcctgctgcgcttcgtgctcctgtgcggagtcgcggatttcaccagaagtttgagtatcactactcctgagcagatgattgaaaaagccaaaggggaaactacctatctgccatgcaaattatgcttagtcctgaagaccagggaccactggacattgagtggctgatatcaccagctgataatcagaagatggatcaagtgatgattttatattctggaaacaaaatttatgatgattactatccagaactgaaaggccgagtacattttaagagaaatgatctcaaatctggtgatgcttcaataaatgtaacgaatttacagctgtcagatattggcacagatcagtgcaaagtgaaaaaagctcctggtgttgcaaataagattcagctggtagttcttgttaagccttcaggtacaagatgttatgttgatggatcagaagaaattggaagtgactttaaactaaaatgtgaaccaaaagaaggttcacttccattacagtatgagtggcaaaaattgtctgactcacagaaaatgcccacttcatggttagcagaaatgacttcatctgttatatctgtaaaaaaaatgcttcttctgagtactctgggacatacagctgtacatcagaaacggagtgggctctgatcagtgcctgttgcgtgtaaacgttgtccctccttcaaataaagctggactaattgcaggagccattataggaactttgcttgctctagtgctcattggtcttatcatcttttgctgtcgtaaaaagcgcagagaagaaaaatacgaaaagtaagttcatcacgatatcagggaagatgtgccgcctccaaagagccgtacatccgctgccagaagctgcataggcagtaatcattcatccctgggatccatgtctccttccaacatggaaggatattccaagactcagtataaacaagtaccgagggaagactttgaacgcactcctcagagtccgactctcccacctgctaaggtagctgcccctaatctaagtcgaatgggcgtgattcctgtgatgattcccgcacagagcaaggatgggtctatagtatagagcctccatacgtctcatctgtgctctccgtgttcctttccttttttgatatatgaaaacctattctggtctaaattttgttactagcctcaaaatgtatccaaaaataagttaatcaggagctgtaaggaatatatttttttaaatttttctttggttatatcgaaatagttacaggcattaaagttagtaaagacaagtttaccatctgaaaaagct

SEQ ID NO: 464487 - DNA, 1133 bp, Homo sapiens
gattcttagttccgagggctacaaggaaccacattcagacctgacagagaatatccttttattcagagatcctgaacttagagctgtatacggtgatcagatgggactttgactgtttctcttggagaagagtgaatgtcttctatatgcaggaagagtgaaacatatttggtgaccagaggtagagtatagccaagaatgctactgcttggcaatatgagctatagcttccggcctcctttaaaattaggagtggtcaattggctgcattctggtcaactgaatataaatgcaaaaggtttaaaggaaatgattacagttgccaccatctccttgattattaattaaaggcttttcttcaattatcatattattccatatagtcaatggttatataagttttataagtaaaaaagataagcaaagcaaaatgttaacacctaccattattcccttcaactctctggcagggtgtgggaaaagtccgaggtttccactgaaggtgaaagcaactcctggctggcagacagcaagaaaacagactaatagccacgagaaattgaattctgccaataccaggaatgtgcttggacagatgttctgcagagttttcatgacctctgttgaatatcaactctgggaaagtcaatatttacggagttttaaaagggagtacaaatcaaaagtaaaagacagcttcagttggcacaagaaaaaatacttcatgggtaaaagagtacaaaagaggaccattaaggatggaagaattggagaatcacttggtgtggaaatcccacacatttggtgtcagaagtgctgccagcaagagggtcacgctagctcaaggagggctccagtcccttttaaagaactcacttgattaagaccaccaaagatcatctcccttttgattaactcaaaattgattaagaacatttattacatttgcaaaattagcacaatcacaagagtgatattccattatatcacagattctatccactctgaaggggagggaattatacaaagacatggatcattagaggtcattttagaattcttattccacaagtcttaaatccagccttatttagctgaattattacatccaattttccagacctcaaaacagg

SEQ ID NO: 464488 - DNA, 1892 bp, Homo sapiens
gtttatttggctaacggttctgcaggctgcacaggaagcaagtcactgacatctgcttctggggagggtctcaggaagcttccactcatggcgggaggagaagaggggccagcatgtcacatgtaatgctattcactgcacatccacttgtcacctgcctctctttgtgctgccctatgggtaccggggctccaggaactggcgtaaaaaacgttactcagcctactgcttttgctgcagaaaatgtgatttcagcgtatgaagtgttcacccatattgaaaagaaagctgcgcacacgactgtggaatttacctctaagagtacatcaattcagggcacttgctacagtgcaaaagggagccagcaggcaaaggatgtgtgcagtcatcgcaagcagaacacagaagggaagcgtgaagctgagagacaggagctttacaggcgctatgggactcaacttgatggaaggcaaaacgcaagaatcaaccaattgttcttgagcaggatttccggatcaatacagtggatgttgcaccaaatcatttcacaataataagtggaaggaaacccatagaggagatgtcctgagtcacaaacaaccatacagttacccaaatttgcatattttaggttttcactgttctcacatctttctatggaatgatcagtttttgaaggacaatcttttggtcccctaataattgaccaattgcatcttattttcttgttttattgcctcagtaactgcagtgcatataatttcctttttctcctctaagtttctcactaataccttaacagtttgggtttatataacaaatgtccttacacttcccaggtaaatgtataaaaaaaaagttctggaactggatgtggtaatggttgaaccacattgtgaagaaacactgccactgaatttacacttgaaagtggctaaaatggtaacttttatgttagtatattttaccacaatagaaaatgcgtagaaaaaaaccgtctcttccatggaaaatttcttctctactctctgttctgacttgttcatgatctagtagttttctctaaggaaggctatgtagtttggagagagactgactcaccaagcctatctccttttcctggaaacacaatcaaattaactttccagtcaccgctgtgtctaggtgtggccatatgagtagttctcaccagtggaatgtagtgaaaacgagatgctgtctcttagggactaaggaagctgtctttcctcttccgacatttgctgactggtcgatgctagatgatcttgagaccctgtgctgaggactggagaactacaggaaaggagcagtatctctgaattatcgtgtggaaggtcacttgtctagcccctgatgactgtgagcctcttcctcctgcttgccacctctcagtcacaagacggctgctgcgactcaggctcatgtcccaattcaaggcagcaagaaggccatggagcggcacctgccagcagatgcccctgcaggccatctctccaggctcaggaacctaaagaagaatctacccagatgtggtggctcacacctgtgatcccaccactttgggaggctgaggcaagaggatcacttgagcccaggagttggagaccaacgtaggcaatacagcaagactcccatctctacaaaaaaaaaaaagaaagaaagaaagaaagaaaagaaattagctggctgtggtgctgcacatttgtaataccagctactctagaggctgaggctggaggatcacttgagccgaggagtgagctatgaccacaccattgcatttcagcctcagtgacagagcaaggccctgcctcaaaaaaaaaaaaaaaaaaagaaaagaataagataaaataaataatacaggagaacct

SEQ ID NO: 464489 - DNA, 762 bp, Homo sapiens
gcccagggcaccagctgccactccatgctctgaatccatcctggcctgtgctgagaccccccctttccatgggctgctccccacccgtgatggggcatggcaggggcactaggcagcccccttcctgagagacatggggctcctctgcctagaatgttgtctcagcacttctcttctgccttgctgaactttccctagagccaaggaggcctccatacaacctttcctctccttcatttggagtcagacttgcactgcagtctaatggtcatcccacttttttccagctccctgataaaatctatggcttctgcttcttggaggacccagattatcacagcttatctcattcctttgcagcagatgcccctgcaggccatctctccaggctcaggaacctaaagaagaatctacccagatgtggtggctcacacctgtgatcccaccactttgggaggctgaggcaagaggatcacttgagcccaggagttggagaccaacgtaggcaatacagcaagactcccatctctacaaaaaaaaaaaagaaagaaagaaagaaagaaaagaaattagctggctgtggtgctgcacatttgtaataccagctactctagaggctgaggctggaggatcacttgagccgaggagtgagctatgaccacaccattgcatttcagcctcagtgacagagcaaggccctgcctcaaaaaaaaaaaaaaaaaaagaaaagaataagataaaataaataatacaggagaacct

SEQ ID NO: 464490 - DNA, 1515 bp, Homo sapiens
gtttatttggctaacggttctgcaggctgcacaggaagcaagtcactgacatctgcttctggggagggtctcaggaagcttccactcatggcgggaggagaagaggggccagcatgtcacatgtaatgctattcactgcacatccacttgtcacctgcctctctttgtgctgccctatgggtaccggggctccaggaactggcgtaaaaaacgttactcagcctactgcttttgctgcagaaaatgtgatttcagcgtatgaagtgttcacccatattgaaaagaaagctgcgcacacgactgtggaatttacctctaagagtacatcaattcagggcacttgctacagtgcaaaagggagccagcaggcaaaggatgtgtgcagtcatcgcaagcagaacacagaagggaagcgtgaagctgagagacaggagctttacaggcgctatgggactcaacttgatggaaggcaaaacgcaagaatcaaccaattgttcttgagcaggatttccggatcaatacagtggatgttgcaccaaatcatttcacaataataagtggaaggaaacccatagaggagatgtcctgagtcacaaacaaccatacagttacccaaatttgcatattttaggttttcactgttctcacatctttctatggaatgatcagtttttgaaggacaatcttttggtcccctaataattgaccaattgcatcttattttcttgttttattgcctcagtaactgcagtgcatataatttcctttttctcctctaagtttctcactaataccttaacagtttgggtttatataacaaatgtccttacacttcccaggtaaatgtataaaaaaaaagttctggaactggatgtggtaatggttgaaccacattgtgaagaaacactgccactgaatttacacttgaaagtggctaaaatggtaacttttatgttagtatattttaccacaatagaaaatgcgtagaaaaaaaccgtctcttccatggaaaatttcttctctactctctgttctgacttgttcatgatctagtagttttctctaaggaaggctatgtagtttggagagagactgactcaccaagcctatctccttttcctggaaacacaatcaaattaactttccagtcaccgctgtgtctaggtgtggccatatgagtagttctcaccagtggaatgtagtgaaaacgagatgctgtctcttagggactaaggaagctgtctttcctcttccgacatttgctgactggtcgatgctagatgatcttgagaccctgtgctgaggactggagaactacaggaaaggagcagtatctctgaattatcgtgtggaaggtcacttgtctagcccctgatgactgtgagcctcttcctcctgcttgccacctctcagtcacaagacggctgctgcgactcaggctcatgtcccaattcaaggcagcaagaaggccatggagcggcacctgccagctccctgattcctttgcagcaggca

SEQ ID NO: 464491 - DNA, 2249 bp, Homo sapiens
actaagaaaggtttgagtaaaaaggaaatgcgttccagaaaaaagacggtattggatataaggcagaatggctaatatccaaacaccagatgctggcaaggatgtggagcaacaggaactctcatttctgatgggaatacaaaatgacacagatcttatggaagacagtttgatgggttcttacaaagctaaacatattcttactatattatccagcagttgtggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccagattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagagcaagcttgctatggcatacctgattcgcggaaatgaactggagttggcagtctgtgtgggcacagtactaggagagtctgcagcaccagcaacccactatgccttagaattactggcgagaaagtgcatgatgatttcagtatggaatttggcagctgatcttcttctgatgattcctgataatgaactacatttaataaaactctgtgctttctacccaggatgtactgaagagataaatgaccttcatgataaggtatgctgatgatgttaaatattctggtttggaatgcagtgctatgatttaattaattgtaggttcaagcaaatagagatgcatgcagagaaacaaatgtgtggtccctttggggtacctacaagtacaacaaaagtgttgtacaataggaagtaacatttactgaactgctatgtgcttggcactcttctaaatctttacatgtatttgtatcttcattctcataaaactttgaaaagcatgggataattatacaaagaaaactcagagaaggtatttgtgtgatggaaaactactaactcattaactaatatcccctcttactgtttttagatcttaaaggtatttccataaatatattctcttaattcaaataatttcatttacatctattttagataactttaataagaaaaccatactaggaaagctgaaagtattttgtacttacactattgcttttatccgtttgaattttagtaacattgttgtcaaatcaattattttctagtgtaagctacccacagtggaagaatgtatgcagttagctgagacagcccgtgcagatgacaatatatttgaaactgtaaaattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagaacttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttac

SEQ ID NO: 464492 - DNA, 1619 bp, Homo sapiens
gcgggctgcctcgggattatttagatgccgctgctgcggagaacatctcggctgctgtctcctcccgggttcctgcctcagaagcgcaccaagctggtcacgatcggcctcattgtcgcctctttgctctggcctctgtgctgcacgcttggctgggctgatgcacttgttggaccgctgacctctcactgtactacgcttctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctctaccaagaacaacgcggccatcctctcggtgtccttcctcttcatgtttgcgctcatcttcagctctacatccagatctgtaagattgtgatgagcacgcccatcagatagcccctgcagcaccacttcctggccacgtcgcactatgtgaccacccggaaaggggtctccaccctggctatcatcctggggacgtttgctgcttgctggatgcctttcaccctctattccttgatagcggattacacctacccctcattctatactacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtagcacccttgcacccaggaggactctgcatttaccaagcacttccactgcctggccaaggtttgagatgcttcccttgaattccttgcattggattccctctcaagccacaggagcacttagcatccgtgaaacaatgacatcgttcagatgagttaagtgattgaagtgaaaataatgttaccagtgttttcaccattaaaaaaaattgttgagctctccactcaacattattttgttttgcttgggggcaagggtttccttttatactttgtttggagggctgactgggggtaggaaaggaagggatatgatacgcccatgatgttattagaagtaaatgagtttcagagtttttacctggactttaaaataaatttgagtgattgaggaaaattgagaaagacttactttttccagactattttttttttacatgatggtagattttttaatgctgcatgtatgtaacagaatatgacccctttcaatccaatacaaatagtttacataattgtgtttggaagggacctgattttgctaacatgaactcagtaatgtcaccgacactgaaaccgtgaacccattcttatccattctttctttcctttcggcaattactgttcacgagaattccttcggtatttctataaatgttgcaactccttctgcatggtcgactgtgttagctagaccacttgtttcaaatgttgccatgtcaatctagattccaacgggtcatttttcaatatagttttccaatatgtactttctaaaatgaatcctgaagtaggttttgatcttcatatgaagtaggattgattagatccaccattgtagtttcttaagcta

SEQ ID NO: 464493 - DNA, 931 bp, Homo sapiens
acaaagctcccattatacatcctgatcagctccttactgttctatgggacctatggcttcaaagaactttccaggactttactcctacccaaataacttttctctctttttgcttctttctttcaatataaattccctaatcacatcaacctcaccaatacaaccactcctcactgctctcaaactagaatgctctataaaccttacacaattcctcctgcagcaacctaactcttcctttgctccagagtgctggatgtgcttatcgctgtcttcctcagcttacacagcccttcctacaccccttcatgaccttttaacaggaaacataactctaatttataaactccaaaaaggagcttcctttttcgatagagctgtctccctggtgatgagagtccaggtgatcggaagttttggggtgtgcaagtatttactaagagcctactaagtgtccagcactgttctaaaagctgaggatacagtggtgaaccaaaacagacaaaactctctgcctttgtggagcttatgttctagtcctttctttccccttgaagcacagaaagcatgtcttcttactattccagtcttcttcttattcttatacatctagtgctccagagcaaaggaagaattagcttgcagcaagaatttcagcaggaattccagaagaatttgtgacacatgtcaggcacatataatctctcattctccagatctgcctgtcttctgcaaaggccaaacaggccaagtgaggacaccttgagatggtggacccccgccagctgggaagaggaccctcacctgaccatgctgatgctctgattgcagacttccaacctccagaactgtgagaaaataaatatttgttgcttaaaccacacacaaaatgggctaagatggtgaattttatgtatattttcccacagat

SEQ ID NO: 464494 - DNA, 960 bp, Homo sapiens
  misc_feature (7)..(7): n is a, c, g, or t
  misc_feature (10)..(10): n is a, c, g, or t
  misc_feature (12)..(15): n is a, c, g, or t
  misc_feature (19)..(19): n is a, c, g, or t
agtcacnttnannnnttantttactagatcttctggataacctgcagtagcttctccatcagcacttgctgcttcaccttgcactgttatgttatggaggtgacctcttttctcagctctcatgaaccaacaacctccactagcttccaacttttcttctgcagtttctttacctttctcagccttcacaaagttgacttagggtcttgctcaggtttagactttgatttaagggaatattgcggctggtttgatctattcagaccactcaaaactttctccgaatcagcaataaagctgttttgctttcttatcatttgtgtgttcactagagtagtatttttaatttccttcaagaacttttcatttgcattcacatatctaactatttggtgcaagaggcctagcttttggcctattgctgttttcaacatgcctttctcactaagcttaatcatttctagcttttgatttaagatgagaggcatggtgttgctgcctttgtgcttgttatggtttgaatgtttgtgtaccccccaacatttttatgtttgaatttaatctccaatgtgatagcattaacagaaagaagtcttggccggctacagtggcgcatgcctgtaatcccagccctttgggagactgaggcaggcagatcgcttgaggtcaggtgttcgagaccaggctggccaacatggtcatcaatctctgacaagaacctttcagagtgcttgatgatattgcaagtagcaagctgtgctgcattaaaagatgatgaatctctgttcaggatggaacggagtgtttggcatctccacttcatctttcgtaaaggctgaatgaactctttgctgccacttattgaagataaaaggaggcagaattacccttaagtaaatactttggcctcagtatttcctccactttgtacattaataaaaatccctttctttcaccctg

SEQ ID NO: 464495 - DNA, 1317 bp, Homo sapiens
tagttcagctaaagatggagtccttatcacacaggcacgaaaattgaggcttgcagacaattgaagagtgagaaaaacggggtttattgggcaaaaagaaaaaaatgggaaagagagacttttagcaaagcaagagagtgtgcttcctgcctgtgggcttcccgcctcgcagatgaattccaggttccacacaggaagaggaggggccaagctcctcccctccgcaaactgcgtgaactactatggctccgctccagtacgcagataatgtcacttgtcaactgaggaatgacaaggttcataaacctagaaagaagagctttcttctcataaagggctgcagcctgcagggcagccattgtgacaggctgagaagcagagcctccagccagaagccagaaacagacccttccaggggcagaagaacaagacaggaatttatgctgaatgagaccgagtctcgctctgtcccccaggctggagtgcggtggtgtcatctcggctcactgcagcctccacctcccaggttcaagtgattctcctgcctcagcctctggagcagctggggttacaggtatttgctgctcagaattggcaaatagaggaataaactctgttaccaaattccttaatttcaggagaacccatgaaaggagtatcatccaatcaggtcaactctctttggtttcctaatgtctaaacatttcacaatttatggaattatgaaaggatccagctccccagaggatgtgagcacatctgaacacaattatgcactgcagccagacaactgttagctttctggggcaaaagacacagagaaagaccaggataatcctttctgggcgaattccaagaaatccctcagaagaaagtgccatgcagaaatatcctggcgggggaactgcccacacagctgtgccagttattcaccctcgccagattcttcatgctctttcccacttcaaggcccttgcattagctgttctccctgaccatgcacttgactctcaagaacatttaggatgggagccttcctgggcagtcactactgggtggggcgctccagtcaagacatcaagacagacagctaaggctttctcccaaaccaaaagacttgcaaacttccctacaagttctgagttttcttctgaagctaacttcttggaactcaatggcatgaaaccgtcatgcagttaaagcatttaagggctgtatatgccctgggggctgtcaatgtcatagacactgtcatttctctctccctgcacaaaaataactaaaatgatgaatccggctggctctcccctctccctc

SEQ ID NO: 464496 - DNA, 699 bp, Homo sapiens
cactgtaggagtttagagggcaaaatagctgccacaagacctaaatgatgtcgggatgcttttcagaaagtctactctgttccctacttctggtgcagttaggcagttgccacttttcagagaagcttgcaggagggtggaatccgatccaaaatgtttgctgggggagaggagacacagaatgcaaatatatggagaccgtgaatttattcacattacaactcagagattcaaagaaactattctttattgtctctatagcttcatctgatatttctcatgagacgctagcctgctgggcaaactacatgaacactttggtggatgagaatgggttcaccagaggcccaaagcctgccccatctggatggccaaatgcatcaaaattaagcagctgtgggtgctgtatttatggaggaatttttggacacaatcaaccttcagagatgactggaggaagaacatagcataaatatggtgaaggatgcggctattcgggtccttggtctgtatattagaagagcactttacaagcacttttacatacttttctgtcaaccaagtcagtaagcaggacaaatagcaccacctggatacaaagactgaagaatggagctgaggactagtgtgacctgaccacagggcattgaactcaactctcccaagaattccctaagtctctcctcctccccctgtgct

SEQ ID NO: 464497 - DNA, 772 bp, Homo sapiens
gaatttagctggcttaacacaatgattgtcaatcaggattctcaagtgtggtccaggttagtcacaactgaatctttcagaggaggaaagagcagaagatctgatgggagaaacaacaggactggtgggatacggggcttaaaagatttgtggaaattaagctatgaagacacaaattttgggttgcacccatccagccccttcatccacacctgtgggatatatttcggaaaaaaaaggctaaataaggacaagaactgtggaataacactgtgttcccaaagaaaacataactgccatagatcacagaatgaaagccccagagcacgcagcagagaagtccagcaacaggagtcaacatttacagaaaaccctgtaggaagactgtggcactaccaactgatcaacatgttacagaactcattttatactgcagccaggctgaggagggcccatcacctgcacataaatatttggacagtggcgacaacttgaagacagctagctgcagagtgatattccagaataagagttttgaagctccagatgactagctgacctgggtattaatgctggatatagcaacgtccttctatgtccttctaaattttcttcatgagtagtgataagttatgctgagaaaaattcttgaacctacagttatacaacattgttcttgccgcctttcaaaaatggacaatgtctcccatatggaatatctactgatgatcttgcaagaaggtgaataaaaaatccaatgaagacataaaac

SEQ ID NO: 464498 - DNA, 2523 bp, Homo sapiens
caagattgtcgcaaattttgcactactgacatcggtggagccatgacaatttaggatttcaagactctcgagtcttccatccagggcctctggatgtgaagctgagatcaacttcacacttcttagatggcattcgatgacctcctaacaaataatctgctacaaccaatagaggagctgtaacactcaccatgaaggtctgcagcttcactcctgaagccagcgagaccacgaacctactggaaggaatgaacaattccagatgcgctgcttttaagagctgtgacattcaccataagggtctgtggcttcattcagcgagaccaagaaccgactgattacggggacactgggtctacaggtgtgcaccaccacacccagctaatttttatattttttagtagatagggggtttcatcatgttgtccaggatggtctcgatctcttgacctcgtgatccaccggcctcggcctcccaaagtgctaggattacaggcgtgagccaagccaccgggcctggccacttacaacatttttataaacaatattttaaagcaataaatctccctttcctcatggaagaaataaattgatgctgtcttgctctgaacacgaacacctaaaatatcacacgtgggctttgagctcactgccttcacccactgcagtgtgagaacgctggcaacagggcttcggttccccagatgtcagcagccaggactgggtacatttctttaaatggcgcccgcaaacgaagtccagatcgcttggatgcagccccctacattggaaagcgtccttcccaggaaaggtctggcttacagccctctctggctggttggctggattccgagagcgcggcctgccccggcccggttaccagagagcggaccccgcggggcgcgtctcccgggcccggcgtcccctccctggcgggtggggagggccccacaaagccctttgttgaggctcccgtgtgacgcgaggagccccagactcggcgcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaccaggccgccggcgccggctcgcggggacccgccaccctggaagccccgcgcacacagcgcattcctggcgagtcggaggcagggtggggcccaggtgtgggaaggagccgaggctgaggccgttcccttctccgcgggctctgtgggcggccgaggcccccacccgtcccgggaaccagttcctcccgggccctgcgcgtccgtccggggaagggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacacctgaagcgcggattgtagatgaagaaactcagcagcgccggcgggaactgcttctcctgggccgcccaggacccgctcccggccccggccgtcgctgcgctgcagccatcctggcccggcccccacctcaggaagcctcccacggcccgcccagagaccgagaaaatctcttaatttcagtggaactcagtttgtttctctttttaaacattgccagttataaatgtattttattttatattatttttatttatttatttatttgagaccgagtcttactctgttgcctggagtgcaggggcacaatgtcagctcactgcaagctccgcctcttgggttcaagtgattctcatgcctcagcctcctgagtagctgggactagaggcgcaagccaccacgcctggctaatttttgtatttttagtacagacggggttttgccatgttggccaggctggttttgaactcctgacttcaggtgatccacccgccttggcttcccaaagtgctgggattacaggcatgagccactctgcccggcttctgtaaatgtatttcaaataaagatttgttttttaaaacagtagtttccaagctggtcatggtggcttatgcctgtaatcccagcacttttggaggctgaggtgggaggatctcttgaggccaagagttcaagaccagtctgaacaaaagagtgaaaccccatctctacaaaagcaaaaaaaaaaaaaaaaaaaaaaa

SEQ ID NO: 464499 - DNA, 899 bp, Homo sapiens
gaaagtgaagatctcagaacctgagctctgccaggttaccggatgattggctcactctctttctgccaccatcttggttcctcgttccctgcacaaaatgccctgtgaagccacagaaaccgtccctgctacagagcaggagttgccgcagccgcaggctgagacagggtctggaacagaatctgacagtgatgaatcagtaccagagcctgaagaacaggattccacccagacgtccacacaagaagcccagctggtggcagcagctgaaattgatgaagagccagtcagtaaagcaaaacagatttggagtgaaaagaaggcacagaaggctatgtccaaactgggtcttcgacaggttacaggagtcactagagtcgctatccggaaatctaagaatatcctttttgtcatcacaaaaccaaatgtctgcaagagccctgctttggatacctacatagtttctggggaagccaagatcgaagatttatctgagcaagcacaactagcagctgctgagaaattcaatgttcaaggtgaagctgtctcaaacattcaagaaaacacacaaactccaactgtacaaaaggagagtgaagaagaagaggtcgatgaaacaggtgtagaagttaaggacatagaattggtcatgtcacaagcaaatgtgtggagagcaaaggcagtccatgccctgaagaacaacagtaatgatattgtaagtgccattatggaattaacaatgtaaccatctgaaagcaacttttcttggtgtctcaaaggagtaactgcagcttggtttgaaatttgtactgtttctatcataaataaagttatggcttcttgttggaaaaaaaaaacctagatgatgggttgataggtgtaggaaaccaccatagcac

SEQ ID NO: 464500 - DNA, 584 bp, Homo sapiens
cctgggcagagctaaggggagaatgatcaaaagccaagctctgtccccgtcagcacaattgcctgagtgggagcagtctttccagcctcgaaaaatgtttaaacaatatgcagatgacctagcacaaataaagaatgctagcaaccgctgttatgtgcacaagttctcacaacagccctttgaatacatgaatcagtcacacctctcttggttgccattgacaggaactcaactgttaggcagaagggaggaatgtactgttgatatggacagactccaagaaggggagggactgctgggactactagaacgagaatgcctctgcccctatggctcagctctgcaactctctctgcacattggcttcatgctgttagaccagcttcctccatatgtctggaaacaaggccactgacagctcccaacatttcatcttctgcctcatcatcagacaggcgagggtttcaccatgttggccaagctggtctcaaactcctgacctccagtgatccgtccgcctcagcctcccaaagtgctggattacaggcatgagccaccatgcctggcctaccaggccaaaatct

SEQ ID NO: 464501 - DNA, 642 bp, Homo sapiens
cctgggcagagctaaggggagaatgatcaaaagccaagctctgtccccgtcagcacaattgcctgagtgggagcagtctttccagcctcgaaaaatgtttaaacaatatgcagatgacctagcacaaataaagaatgctagcaaccgctgttatgtgcacaagttctcacaacagccctttgaatacatgaatcagtcacacctctcttggttgccattgacaggaactcaactgttaggcagaagggaggaatgtactgttgatatggacagactccaagaaggggagggactgctgggactactagaacgagaatgcctctgcccctatggctcagctctgcaactctctctgcacattggcttcatgctgttagaccagcttcctccatatgtctggaaacaaggccactgacagctcccaacatttcatcttctgcctcatcatcagacaggcgagtgcagtggcataatctcggctcactgcaacctttgcctcctgggttcaagcaaaaactggaatgatgcagcttcaggccaaggaatgctggcagccaccagaagctgaaggacacaaggaatggattctcagagcctcggcaggaaatgtggccctgccaacaccttgatttcagacttctc

SEQ ID NO: 464502 - DNA, 1142 bp, Homo sapiens
agactaacataggatggttaagaaaaacaaacaaacaaacaaacaaacctacagtcatccttggttatatacagggtattggttccaggacccccacagatatcaaaatccgaacatactcaagtccatactcaagtcctacagaacccatgtgaaaagccagtcctcaggttttgcatcctgggaatacttcgagcagctcaaaggtttcttttcagcagcaatggctcacgtggctgcttctcatatggacaggttgctgctgccaagcggggaggaccctctgctcattagcactccgatgagtggcttgctatgggcaggtcccccagacgcctctcccccagtaagctggccacactgctcctccagggatctcagagagatggcagcttgtcaagttcctgagtcgctggtctcaatgtaggttgctgcaaggtttgatgctttaatgacatcatgaaggacccagccattccatctctctgctttgcattcctcaatgtgtcagctttgtgccagagtcacaagacggctacactcctccaggcattgtatgcagatataacgacataccccaaaagaagagaagacttctccagaagcctcccaggagaccttcacacatggcttattagatcagagcccctccttaaaccaatcactaaaaaggaaaatggaattgccatgagtggctcagcaaaatcatgatttacccctggatgggaatcagggtcaccttcaaagagcatatggacatgtgaaggagcataaacacaatcacaaaattggggctcccaccatcggttgcagaggcagtcggcagtgtctgctacaagtgacatcaagtagcatctatcaagtggcattactttaacaaatattaacaatagggtcctcatctcagtttagaagaaaaatccaaaatcaaagtagactgaagataaggtaaacggtgatgtttgccacactagtggtgaggttttcatagttttacccaaaccagtttttatttttagtgcttggttggggtcactgaaacttccaggttgtcctaacctgttaaaatcttttaaaacattatttgtgactgtttctctttggacagtgctttttgttaatcacaaaaaacagggtagaag

SEQ ID NO: 464503 - DNA, 615 bp, Homo sapiens
ctgactctatccctagcccaatccaggtgattgagaatgatagagccagcagaggaggacaagtttatgccaccaacaccagaggccagatcctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagaggccatctttgaagaagtaaacaagtaccatacactaaagggatgacagaacaacgaaacaaaagattacagcaaagctttctgctttcctttcttgctctgataccctcaaaattatactctgttcctgggattccagagtcttctgccacaaccaaggcttccgaggcgatccggcaacatcagtcttcagccgctaagccaagaagatctgggaaggagtcaatcagagagccttgggccagagttccaggggctgtggaagtggctgccagtgctatgctggtggtacaggctcagtgatgggaaattcaagtaaggaaaatagaagactatgaaagtcggtgaattcaaa

SEQ ID NO: 464504 - DNA, 969 bp, Homo sapiens
ctgactctatccctagcccaatccaggtgattgagaatgatagagccagcagaggaggacaagtttatgccaccaacaccagaggccagatcctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagaggccatctttgaagaagtaaacaagtaccatacactaaagggatgacagaacaacgaaacaaaagattacagcaaagctttctgctttcctttcttgctctgataccctcaaaattatactctgttcctgggattccagagtcttctgccacaaccaaggcttccgaggcgatccggcaacatcagtcttcagccgctaagccaagaagatctgggaaggagtcaatcagagagccttgggccagagttccaggggctgtggaagtggctgccaggaaggcacccctgcggagatcagacaccagtggaacgtgggtgaataatccaagaggcatctcggcgatgattaaacaccaagaatatcaccaaccagtgactgctgtatgccttctgactttctcctttggattgggcatgtttattgtgggtattctccccccatgtcagttttggtggctgagaagtccaagatcaagatggcaacgatggggaaaagggcccctaaaggctgtcattgggagcacattcctgaaggacatgttgaaagatgagaaagtcttcacccagtaaataagcaataaacactgccagctgactcgaaagccgctagattttcaactttgttttaagaagctcatgttttcttggaactggggatgggctgctaggatgccagaggcatctgtgtcttctgctgcccatagcaacc

SEQ ID NO: 464505 - DNA, 2081 bp, Homo sapiens
ccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaagttcagtgagtgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggatttcatgctattcttacttccacatctccagcctccatctcctgcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggagaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaaggtgctatccgcccccaccccccagactacggggacttccagcccctctctgtgtccccagcatcccacccacattagaagctttctagaccctgtcccactccctcaatcagtcaaaaaagacttccccaaccaccacatccgttccacctttccacttagacactcctgagtcctgcatctctccagactctttgtgtcaggagaatcaaacacatgttcccaaacttcctatcttaagaaacagaagccccctttccattcggccttttgtcatagggacagaaatctcaggtcccccaaactcctgcctagaaggacatggaccccatgtctcccaaacttcctgtttcagagatgtgaaccttctatcccccaaagctcctccatcagaggaccccaactcctccatgcctgccacttccccttacctggggcacactagttccccctccagcccctgtgtactttcaccaatcccccgaccctcctcatcacacacaacttcctcctccctaccagggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacggatcccacgaaactacaccatgagcttcctgccccgctgagcgagggctgtgccggtgcaggtctggtgggcggggccagggaaagggcagggccaagaccgggcttgggagagg

SEQ ID NO: 464506 - DNA, 542 bp, Homo sapiens
actcatccgtcctagctcctggacgctggaccgctcctcaactccctgctcagggggagactagctcctcgtattatgttcagtctctacgtttctctacagaaagccctcccaagtcccacggcagctgggtcttcatctctccactgcacccagaatcacacgctgacccagataaagctcaatgcagtgaacactcttggtctggaggtccaacatcagggagttgccgggactggtttcagacacacggaggaggagacacacagagaaaaggaggcagtgatgtgaccacagaggcagagattgacatgatgcagccgcaagaggcagagttatgcaggcctcacgatgcaactgcttctggaaaatgcaactgcgtgcatggtgaatcttcagctgttactccacaggatccgctgaacataggatgtgccagcaaaatctacctcgtgtattcttcctctttcactcatgagctgcacaatgcggatctgagcacaatgtctgcagactgtgtggacaaacctctgaagaaccta

SEQ ID NO: 464507 - DNA, 1033 bp, Homo sapiens
actcatccgtcctagctcctggacgctggaccgctcctcaactccctgctcagggggagactagctcctcgtattatgttcagtctctacgtttctctacagaaagccctcccaagtcccacggcagctgggtcttcatctctccactgcacccagaatcacacgctgacccagataaagctcaatgcagtgaacactcttggtctggaggtccaacatcagggagttgccgggactggtttcagacacacggaggaggagacacacagagaaaaggaggcagtgatgtgaccacagaggcagagattgacatgatgcagccgcaagaggcagagttatgcaggcctcacgatgcaactgcttctggaaaatgcaactgcgtgcatggtgaatcttcagctggcaagagatgctgagagctcagcccaagcaggtagctatggaggtggtaagatgtgggcagattctgggtatattttgaagatagggccaacaggatttactgagagactggagatgtggacagcatctaaagccacggacccatggtctcaaccaggggaggagtgtggacagaggagaaaaacatcagggactgagccctggggcacaccaggattcagaggacccagccaagagactgagaaggagcagccggggagagaggaggcaaaacagcagagtgagtgcataagcatgtgctcgcatgctacacaaatgcccagtagaaaggccgtgtggctctctgttgttgcctatgactgggagaaggtagagtgtgtctgtacccctttagcctgtgagaggctgtacgcatcacggtaaagcactggctttggagtcagacagtacttctctgatcatcgaccttctccagtattagttacctcctctgagagaatcatattacatcagggctgctgccagtccacatgggacttttggacaaattagaagaggtggcccttatgctttactttcatctgttgaaaaattgtcataatatactgattctgtttgaataagacccttt

SEQ ID NO: 464508 - DNA, 477 bp, Homo sapiens
atagaactaaggctagtagagctcgtgttaatcggcagaggctccggcgtcaagtgattctctgcctcagctcccaagtagctgggattacagccctcccaagtcccacggcagctgggtcttcatctctccactgcacccagaatcacacgctgacccagataaagctcaatgcagtgaacactcttggtctggaggtccaacatcagggagttgccgggactggtttcagacacacggaggaggagacacacagagaaaaggaggcagtgatgtgaccacagaggcagagattgacatgatgcagccgcaagaggcagagttatgcaggcctcacgatgcaactgcttctggaaaatgcaactgcgtgcatggtgaatcttcagctgccagaacaatcacttctcctggagacagattcattatgaaaggactttaattctggtctgacagactgcttgacattggagtgaattc

SEQ ID NO: 464509 - DNA, 3417 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctgtgagtgctgggcgaggccccacctggagggagaatctgagcacctgggccccagctcagcctctgccccgcccctacccctccagggcaaacgaggagatcgcccaggtccggagcaaggcccaggcggaagcgttggccctccaggccagcctgaggaaggagcagatgcgcatccagtcgctggagaagacagtggagcagaaggtgggtgcgggaagcccagctcaaggggccgtctggcagcaccttctagaaggcccttgggcctgctgctccctccaagcagggagaagccccgcaactcatcttcctcctccagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaagccgctctggtcttgatgaagcaaaggtttcccagctctagcctgaggctgagccgacccgcaggtgccctcccttcccctcagagctggccacttggtccctgcctaccccaggctcaggcaaacaacccgaggggcagggacagccagtggatagaggaggctcaggcctgcccagtctgccccggcacctcgggttggctacatggtcctggcctcaggtacacacatcaaagtccaaatggactcgtttttttgtttgtttttttgtt

SEQ ID NO: 464510 - DNA, 1024 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgg

SEQ ID NO: 464511 - DNA, 374 bp, Homo sapiens
  misc_feature (236)..(236): n is a, c, g, or t
  misc_feature (240)..(240): n is a, c, g, or t
  misc_feature (255)..(255): n is a, c, g, or t
  misc_feature (264)..(264): n is a, c, g, or t
  misc_feature (267)..(267): n is a, c, g, or t
ggcctctgctgactctgtctccccaggcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggtctnggcncgggcgcggaggtgnttacctggngcngttggacttctcgttaggagtcgcttagagcagtctttactcagttaccctctagacatctgtaacagtccgtgcacgagacagcgctccgtgaataatccagatcg

SEQ ID NO: 464512 - DNA, 2944 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464513 - DNA, 3001 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtcagaggtaagaggcaagggcgaaatgggttcctgtttcatccccatctcccgcaggtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464514 - DNA, 1975 bp, Homo sapiens
tagggggcggggggcccgggcgggcgggcggggggcggcccgcgcgggccacgcccccgggcggcccaggcgccgcggcgggcccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464515 - DNA, 1714 bp, Homo sapiens
tctaatcgacggtaggagcggagcaggagaggatcccccatgcagcttctcggggctcttaccacctcgactgggacaaaatggatgacccaaacttcatcccgttcggaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464516 - DNA, 3145 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctgtgagtgctgggcgaggccccacctggagggagaatctgagcacctgggccccagctcagcctctgccccgcccctacccctccagggcaaacgaggagatcgcccaggtccggagcaaggcccaggcggaagcgttggccctccaggccagcctgaggaaggagcagatgcgcatccagtcgctggagaagacagtggagcagaaggtgggtgcgggaagcccagctcaaggggccgtctggcagcaccttctagaaggcccttgggcctgctgctccctccaagcagggagaagccccgcaactcatcttcctcctccagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464517 - DNA, 793 bp, Homo sapiens
ccccagattatcccaagcttttaccgcacagccagaaggaccggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464518 - DNA, 1662 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgagaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464519 - DNA, 835 bp, Homo sapiens
gtggcgtggggcagctgccctgcagtgtatgtggtccaggacccgaggccagaagtgtcatcagatactcctttgaggccgggtaggttctgcctgaggaggggcctctggataaaaacagggctcaggtggctcccagctgagggtgcttggccttgccttggctgccatgcatctctttagtgctcctggcctaaggagggatccaataagggcgggctcaggccagaagccaaatgcaaccaaccctgggcaggaccctgtcccccagtcatgttcctcctcaggtgaacttgacttgggtgtgtaactccaaaagccaggcaaagcctgttactgcctgggtggcgtccgctgcttgctggggtcttggccgtgggtctgctgcctcctggctgaatggtcttaggctacatctcctagagttgctcagtgggagattgtcctgcctgtagggtccagccctactgggtctgtgggttttttctcctcgtgtgcatagacaagagattgtacaaataaagacacaagaaaaagacagaagaaaagacagctgggcccgggggaccactaccaccaaggcacggagatcggtaatggccccgaatgtctggctgcgctgttacttattggatacaaggcaaggggacaggttaaggagtgtgagccatctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464520 - DNA, 479 bp, Homo sapiens
aggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaaggtatgtctccgccaccctggtgtcctcacctcggaggctgatggactcatggtccaagccagcggggctacaagctgctgtctttgcaccttggtccttggccaagcctccccttgccacgggggcatgggatgacctgtgaacgagacagggtgcaggagtcacagcatagctggtttgcgaggcagctgagggcggcaggaggcagagtgagcagggaggccatctgagccgtccgctgttgtgtgacagacgactcggctatgatcaggcatctgtgagatttgagacagcgctggtgcaccggggcctggggca

SEQ ID NO: 464521 - DNA, 598 bp, Homo sapiens
ttggcccctcaggccaaaaattcggccacgagggaaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464522 - DNA, 2854 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464523 - DNA, 3380 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaaaaaaaaaaaaaaaaacaaaaaaaaaaaaaaaaaacaacacaccacaaaaaaaaaaaaagcgggggcgcgcccaaaaagacgcccccgaaggggaccccactacccagccacaccgagtcctatggacaacacaaacaagcgggcccacaaacgcacgcgcgaggcacacaactacaccagaagagagcaaggcgcacccagaacaaaacaaaagcgacagcggggcggcaaacacctgtgcgaaaaacaaagcgagcgtaacactctccggggaaacaacaggatctctactaacatctcccagcggcagcgcacgacacaacatctttgtggaagcaattcaccaccacaacaatcgaagctatgatagaagcaactcatcaagcggggatggaaatgtgtcacgacttgcgctcacgctgtgtatcataaagag

SEQ ID NO: 464524 - DNA, 3059 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaaggtgggtgcgggaagcccagctcaaggggccgtctggcagcaccttctagaaggcccttgggcctgctgctccctccaagcagggagaagccccgcaactcatcttcctcctccagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464525 - DNA, 1913 bp, Homo sapiens
  misc_feature (278)..(278): n is a, c, g, or t
  misc_feature (280)..(280): n is a, c, g, or t
  misc_feature (286)..(286): n is a, c, g, or t
  misc_feature (296)..(296): n is a, c, g, or t
  misc_feature (299)..(299): n is a, c, g, or t
  misc_feature (306)..(306): n is a, c, g, or t
  misc_feature (308)..(308): n is a, c, g, or t
  misc_feature (311)..(311): n is a, c, g, or t
  misc_feature (314)..(314): n is a, c, g, or t
  misc_feature (317)..(317): n is a, c, g, or t
  misc_feature (323)..(324): n is a, c, g, or t
  misc_feature (326)..(326): n is a, c, g, or t
  misc_feature (328)..(328): n is a, c, g, or t
  misc_feature (331)..(331): n is a, c, g, or t
  misc_feature (336)..(336): n is a, c, g, or t
  misc_feature (348)..(348): n is a, c, g, or t
  misc_feature (361)..(361): n is a, c, g, or t
  misc_feature (366)..(367): n is a, c, g, or t
  misc_feature (372)..(372): n is a, c, g, or t
  misc_feature (374)..(374): n is a, c, g, or t
  misc_feature (382)..(382): n is a, c, g, or t
  misc_feature (402)..(402): n is a, c, g, or t
  misc_feature (443)..(443): n is a, c, g, or t
  misc_feature (483)..(483): n is a, c, g, or t
  misc_feature (517)..(517): n is a, c, g, or t
  misc_feature (551)..(551): n is a, c, g, or t
  misc_feature (566)..(566): n is a, c, g, or t
  misc_feature (582)..(582): n is a, c, g, or t
  misc_feature (640)..(640): n is a, c, g, or t
  misc_feature (665)..(665): n is a, c, g, or t
  misc_feature (727)..(727): n is a, c, g, or t
  misc_feature (771)..(771): n is a, c, g, or t
  misc_feature (777)..(778): n is a, c, g, or t
  misc_feature (798)..(798): n is a, c, g, or t
  misc_feature (804)..(804): n is a, c, g, or t
  misc_feature (822)..(822): n is a, c, g, or t
  misc_feature (829)..(829): n is a, c, g, or t
  misc_feature (833)..(833): n is a, c, g, or t
  misc_feature (848)..(848): n is a, c, g, or t
  misc_feature (857)..(857): n is a, c, g, or t
  misc_feature (860)..(860): n is a, c, g, or t
  misc_feature (872)..(872): n is a, c, g, or t
  misc_feature (896)..(896): n is a, c, g, or t
  misc_feature (899)..(899): n is a, c, g, or t
  misc_feature (934)..(934): n is a, c, g, or t
  misc_feature (949)..(949): n is a, c, g, or t
  misc_feature (979)..(979): n is a, c, g, or t
  misc_feature (981)..(981): n is a, c, g, or t
  misc_feature (983)..(983): n is a, c, g, or t
  misc_feature (985)..(985): n is a, c, g, or t
  misc_feature (998)..(998): n is a, c, g, or t
  misc_feature (1063)..(1063): n is a, c, g, or t
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccncncccccngcgcccgccncgnccccccncncgnccnccngccccnncncnccnacccnctcgcccccccntcccacccccccngcccnnccccncnccctctcncccccccccccccccccccncccccccccccctcccccgcgtccccccccccccccctgcnccccccccccccccgcccccccccctcccccgcccccccncccccccccccccccgccccccccccccccccgncctccccccccccacccggccccccccccccccnccccttccccccccncccccccccttggccngccccccccccccccggccccgccccccccccccccccccccgcctcccccctccccngccgccccccctcccgccccctccncccccccccccccccccccccccccccccgcccccccccccccccccccccccccccccccnccccccccctgccccccccccccccccccccccccccccccccnggggcnncctgccttggcgctgacagnggcgcncttccgcgcccccgctgnggttctnggcncgggcgcggaggtgnttacctggngcngtttggcccttnctcgtttccggcgtcggccttgangangccgtccttctccctcccgttcgcccccctcctgngggcccgtcctggtngcccagtgcccgtggccaccgcgccccgcngncngnccggtgcccctgngcctcctccggccgtccgcgggccgccccgcttgtggcgttcgctttcttgggcgccctggcccntcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464526 - DNA, 1980 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccaacaagagattgtacaaataaagacacaagaaaaagacagaagaaaagacagctgggcccgggggaccactaccaccaaggcacggagatcggtaatggccccgaatgtctggctgcgctgttacttattggatacaaggcaaggggacaggttaaggagtgtgagccatctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464527 - DNA, 1059 bp, Homo sapiens
ggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaacctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgagaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaa

SEQ ID NO: 464528 - DNA, 1380 bp, Homo sapiens
caggaaaaaggggtgatgccggccccgggcaaggtgcaggcattatctcctccagtgctcagattgcacactcatgagaggtgagcaagcttccaagaacatccaatgccgatgctccagaaaagcctttaacaaaagtcagaggtccatggtaaggtaccaggtgaaaactccatcagatgatatctgtacagagctagtcaaatcctgcatagacctggttgtcacagaagtatatggaataaaaggtggtactgtacctatgaatgtagacatgctccacaagtacattttcaaccttctgcttttctctctggatatcctcttcccagagagctcaaatgttcccaagttgtccctgataatacctccaaacaccaccttgagcagtgctacccaacagaaataccaacagcagaaaatgcatctggtatgtgccttgcccttagtagttcaatactcatatgtgaaaaattattattttttgtgttttggaatattgctaatgaactacagataaggcagagagtgtaatgaaaacaaaaataaaatggaaatatataaataaaaaaacacaaattaccatttctttctgtaaatctttgtacatttgggggaaatctatatttgcaggaatttggaggaaaaatcaacatgaaacaaaggtttttcaggtgttcattagagtgtgacagggaaatacaccaaaatgttaacattggttgtattttttctgcttctatgtacttgtcttcatttacctgttatcaagagtaagcatgtataactcttaaggaagttataattatacaataaaaacccaacaccaaaagggaaaggagagggaggaatacagaggactttgtcttgcaacttgggtgccagctcagtcacagtaaaataaaccacaaagcagattcttaaagcctctgattctagggcccggctcctggacagcatttctaaacctgcttgggccagaagggaacctgctactctcaagatgttactacaaacattcaaactgatacctactgagaagcactctaggctaagtggtttggaaattctgcatcccccagaatgcttcaatgcttctgatgaaagccctgatatatgggattcctgttgtgagatcctaggtgaataatcctaactgcaggactaatattggacatactcagagacagacttcataaggccaccctcacttttccacatcaggtggaaagagaaaaatgaaattattacctttcaaaatatttgtctgcttgaattatttcactcttacccttaatagtaacaccaactataatttacttgctccagagacaaaatcaggtcttcacatatccttgaggcaactctatgtgttgcatg

SEQ ID NO: 464529 - DNA, 1237 bp, Homo sapiens
ataaggcccagccccgccttctgctgttgccgcagcaacccagaaagcgtcatggctgccgccggccaggaaaaagggtatttgacacagactgcggcagcctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagagatttttcaaatggcttcctaattgcagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttccataattgtgttaaagaacatttcttttccattcaatttgtttattaaactcctatgccaggcatttctatattacctagctctgataaggaaaagcataatttcaaaaacacaagatgcaatacaaattatgttttcttaattaggttctaaa

SEQ ID NO: 464530 - DNA, 737 bp, Homo sapiens
ttaagaggcaggtggagggactggttaaaaaagggtgaaaaagtggtgggttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttcca

SEQ ID NO: 464531 - DNA, 1085 bp, Homo sapiens
ataaggcccagccccgccttctgctgttgccgcagcaacccagaaagcgtcatggctgccgccggccaggaaaaagggtatttgacacagactgcggcagcctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagagatttttcaaatggcttcctaattgcagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttcca

SEQ ID NO: 464532 - DNA, 1056 bp, Homo sapiens
ataaggcccagccccgccttctgctgttgccgcagcaacccagaaagcgtcatggctgccgccggccaggaaaaagggtatttgacacagactgcggcagcctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttcca

SEQ ID NO: 464533 - DNA, 265 bp, Homo sapiens
gacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttccataattgtgttaaagaacatttcttttccattcaatttgtttattaaactcctatgccaggcattgttgaaaatacaaaattaaataaat

SEQ ID NO: 464534 - DNA, 553 bp, Homo sapiens
ctctaacctgcgaacaaatctatcaagcagacggcacagtactgaatttgaaaccagaaatactgggtttttatataaatgcttcatagatttgttttatgataaagggcacataactctcctaaacctcacaccacctcttgaataggtataataagtccacatcaatgctgatgccttagctattattaaactcttacagtatgatgtaaagtgaaagtacaatgtaagatcattcctaggccaactttgaccagttttatacagaaacatgtgccaacttttctgtttgcaaggataatatcaaagcaaacaccagaaagttatatctttgatgcatttttttcaaaatcatacacataatacacaaaccaaagacaaatgatgaatattatgtcagaaaatataaagtcttcccctttcttcttttgccaagaaagtccaatattttcaccatttttatgcacacaatcaactttatttaagctggaagttaatgtctcattgttttcattgttctaaataaacaccttttcccttgagtattgttcta

SEQ ID NO: 464535 - DNA, 4053 bp, Homo sapiens
ctctaacctgcgaacaaatctatcaagcagacggcacagtactgaatttgaaaccagaaatactgggtttttatataaatgcttcatagatttgttttatgataaagggcacataactctcctaaacctcacaccacctcttgaataggtataataagtccacatcaatgctgatgccttagctattattaaactcttacagtatgatgtaaagtgaaagtacaatgtaagatcattcctaggccaactttgaccagttttatacagaaacatgtgccaacttttctgtttgcaaggataatatcaaagcaaacaccagaaagttatatctttgatgcatttttttcaaaatcatacacataatacacaaaccaaagacaaatgatgaatattatgtcagaaaatataaagtcttcccctttcttcttttgccaagaaagtccaatattttcaccatttttatgcacacaatcaactttatttaagctggaagttaatgtctcattgttttcattgttctaaataaacaccttttcccttgagtattgttctaaaaattttgaagttgtgtgaaaaattttgttctgatttttcacatttgtgctaatgatatgtgaaaaggaatacagatggtatttaattatgaacaggaaaagatgttaaatatcattagtcattagaaatttgcaaattaagaccacaatgactaacacatgtatatcagaatagctaaaataaaaataaaacatcaaacgctggggagcatgagtaaaaactggagctttcacacatgactcgtgggaacgtaaaatcgtacagctatgccaaaaaggagtatagtagtttcttaagaaactaaaggaacctgagtccccaggcctgcagtctgggccaaggtcactggccctggatcaatcaggatggggttcaggggccttcctggggccatccagtgtccaaggtgccctttggtggcctcgtctgcccctcagcccctgagcacgtccctctgtccctccaatcctccctgccatgggacatctgtcacagagccatgccctacctcctgctttctggagatgccaactgcctggggtgctcttagccctgccctccccatctctgggtcctgaccaaggtgttctaatggacaccccctgacccaggtctcagagagctgccagcaccctgggtccctgaagctaagatccagcaagacacatgtggcctgagagtcccactttctggctggcagaacccagaggtgggagcacactggagtgtccttcagggtgtcttcaccccatgagagggctgggggctttgggagtttgcagctggcaggagtcagggcccagtcccctaactctgatgcatccttggttaaatcctgtgcctcagcctgcagggcctattgtggtcaccagacaaaaggtggagcctggcatcctgccctgcgtgggctccagcctgctgccatctggggaaactgagtcatggcgaggctcaaggatgtttctcagaccacaccagtccctgaagaactgctatgctcgctaccaccaggccttcgccaactgcaaccagtcagagcaggagctgcaggggcatgaaagccagcagctggccgcagagacccaggcgctggcgcaggggacgcagcaagactccacgcgcagggtgggcgagcaactgcaggacacgcacagctggaagtcagagctgcagcgtgaggtggaggcgctggctgcggagaccgacctgctgctggcccagaagcaacgcctggagcacgccctggatgccacggaggcgcccttctccatcgccactgacaacctgcagtgcagccagggccaccagaacgctaacctcatgcgcgaccatgtggagacggagctgctgaaggtgccagcagccgcccatccccctgcaccctctcagtgcctcaataactgcttcagctctcgcaaaccctctgcccgcaacaagggcccctgccaagtgatggagacactgacagtgcaggaagaggcaaacccagggacagaagggtgcaggactcgggccctggcacacaagaaggaagctgagctcatccggaacattcaggagctgctgaagagagccatcgtgcaagcagtgagccagatccgcctgcagcatggaggatccccagcggtgccctccccggccacacaccaaggccctgccccaccccgccccagactgaaccgggagcacacggagatctgcgagatggactggtcggacaaggtggaggcctacaacctcgacgagacctgcgggcgccaccacagccagagcaccgaggtgcaggctcatccggcactccaccaccttccaagagaggggggccccagctctgcccccacacttgccctggctgtggtctcgcctccctctgcctgggggccccagcggcgctgcttcccccagcctgacccggaggccctcgcccccgaggacacttgggcaactgtctgcccctggcatgacgcctccaccccggagacctggaccaagttcacgcaggacaatctgtgccgctcccagcgcgagcacctggactcggccaacctgtgggtgctggtggactgcatctttcgcgacacctccgaggacctgggactccagtgtgacgctgtgaacctggccttcgggcgccgctgtgaggagctggaggacacgcggcacaagctgcagcaccacctgcacaagatcagaaacaacgtggcggcactgaaggaggccatcaaggacaaggaggcacctctgcacatagcccagacccttctgtacctgcgcttgcactggcccaacatggagctgtgtggcaatgcagcccagttcagacatgacactgggcaggtcatgggtcgggtgcctctcagtgccagggacctgtgcccacgtggtctcaccccaccctgtgctacctcgtcttcccgggaagaagctccttcagacaagccccagctcacaccccccaacatccccaagctggtgagtgaggtggaggagctgaacatgtccatcacagcgctgcgggagaagcttctagaaggggagcagtccctttgcaacctcgaggacatccacatgagcctggagaaggacgttaccgccatgaccaacagtctcttcatcgaccgccagaagtgcatggcccatcgtacttgctaccccaccatcctgcagctggctggctaccagacccctccagaggccactgctgaagacgaaaaacactactgccgttcactgggggaggcccaggtggtgctgcccagccctgtcgggtccccatcagtctcaggacctccttgtcccaccctggagggtgtggctgatggagagctgagtgtggaggatgccaggggagggggcctgggagacattgtccaacccccacccctgaggccatctggacactggcagctgctgctaacccacaggcccctctgtggagtccccgttgacctggccttgaactcctacccatggtggagatcagtggagcctggacacagctgccccctccgtgttggggtcgccctcagctgtctcatgtctgggttccctcatctgccccctgtgcagtggctcctagagatcactctcacaggcatcagatgcatggctcaaggacacagaaacccaggcatccaggagcccaaggtctcacacccagggagcgaagggcttgccaaggctcttaccccagtgcccatcacccctgccagcatcccagagtacagtgggggagatgccattggtctgagccgtgcagagctggttccaatggctgcaggcaccacagtcgcagagctggaagaaacaagaatcctccccaagagtctgcagagggagtgcatttctgcccacaccttgattttggacttgtggcctccagaacggtgagagaataaattcctgatgttgtaagccatcactacagcagctcctggacactaatattgctcagtccgtccaggctcctctctctgtttgttgttgttctaggttttt

SEQ ID NO: 464536 - DNA, 1331 bp, Homo sapiens
cagccaccggccccctcaagccccgccccccagtgggcggagaaggcgttacaagccaagggtgcctggtgtcaaatcttatgtactgggactcctaaaacatctgaagtctaccatctccttcctagcctcatcttcctgggcccttaaatacctcttcctagatgaaggcagcaccttgagactaaattcaacccaacactacaggttgggttgcagatatggccttgaagcaatggtaaaggaaaaagaatcagaaaattggctgccatcgctacaggctgtgtacttagttatgtgtcatctgtatctctactgcaacccttgctagaatgtgtgccggctatgagcagggtcactgtctgtcttgttcactgctagatcctcagcacgtggaactatacctggaacatggaaggaagtcaagcaatatttatttaatgttaaataagtgaatctctgtagcattaatggtaaaaagacttccatatttgccttcaattagattttaagatgacagtctataaaaaacagcttgcaatatacagaagttcatttaagaataactttgctggtatctattctcttgaggtatacttacatgctatttttttcaaaatcacgaagcaatcagtatctgccaaacggaatgaaagctggatcacaaagagggataaagaagagaaagcaatatatatgctaagcagcagcacttctccaaacacagccccaggtagaaccaatctagcaaagagtgacctgtcagtcatgcaccagccaaagcaagctgtgccaacttgtaagaagtcagaagataccagtgctctatacgcttgtctgttttcaaacatttatattttcctttcctctcaccctgacagaatgccccctcatacacagtcaaaaattaaattgactattttgggggagcagcacatcacagaagatcatttctaattttatctaactgctaccacaatgtctctttcagctttattgcttccatatttctatgtcctatgaatatttttccttcaactattaattttccttttaatttcttcactacattttctatcatctttctgtggctctgatttctgtgtaatattttgtgacccttatcaatggcccagagaacataggaaagcctaaataaataagttatttgttccgtataaacagaaatagaaacaggaaaatgagagtatttctgcaaatgccttttcagtcctatagaattagaataatcaataatagttttaaattatagccttaaattctaaaatgcctaatgggagtatatagtaccatgtggaatttttcagtgt

SEQ ID NO: 464537 - DNA, 964 bp, Homo sapiens
gccgcgatgtaagacgtgcttttcaccttcggccatgatcatgaggcctccccagacacatgcaactataagtctattaaatctctttttctttataaattatccagtctcggtatttgcaagattgtgtgggaaagaaaaagaggaggaagaggagaaagaagaaagaaaggaaagaaaggatgaagggaaggaaatagagaaagaatgtaagacttcaaatgcaaagaagaaagtgcaaaatccagtcaaatgttttggctggttgagaaatgaaagcagcatccttgaacagtctgtaatggcccaaatgtacttcaagaatgcagcaattgaaaacaagtcacccggagcacacagactagagtctctgtgggccaccatgcatgaggacattcaagcagccttatggagcagtttacatggagaaaaactaaggcctcctgccaacagccagcaccaactggccatataaatgaactaccttgatcatgaatgcagactctctaaagcctttacatggatgcaacctcatgagagacccctgtccagaagaacacaattaagctcctgaattcctgacccacagaagagctgtgagatactaaatgcctattgttgttttaagccactaaattttgagacacgcattttaaaacccatcaaaaaagctgacaagtcaggaatccgttttaggacacctatgggcatattctgggaaaggagtcttaatcattgagaagcaaactctggagccatttcatggagggatcttaaaggcacacaaccattggttttactgcacatgtgtcaccgtctgaagccatcctgcaactctcacgagtcatctgctctgaagtagagcacacctatttctggaaaaagaggatcagactgtctttttctgagtgtggttggcatctatgggataggctttcctggttaaaaactagttagttaaaaa

SEQ ID NO: 464538 - DNA, 1391 bp, Homo sapiens
gccgcgatgtaagacgtgcttttcaccttcggccatgatcatgaggcctccccagacacatgcaactataagtctattaaatctctttttctttataaattatccagtctcggtatttgcaagattgtgtgggaaagaaaaagaggaggaagaggagaaagaagaaagaaaggaaagaaaggatgaagggaaggaaatagagaaagaatgtaagacttcaaatgcaaagaagaaagtgcaaaatccagtcaaatgttttggctggttgagaaatgaaagcagcatccttgaacagtctgtaatggcccaaatgtacttcaagaatgcagcaattgaaaacaagtcacccggagcacacagactagagtctctgtgggccaccatgcatgaggacattcaagcagccttatggagcagtttacatggagaaaaactaaggcctcctgccaacagccagcaccaactggccatataaatgaactaccttgatcatgaatgcagactctctaaagcctttacatggatgcaacctcatgagagacccctgtccagaagaacacaattaagctcctgaattcctgacccacagaagagctgtgagatactaaatgcctattgttgttttaagccactaaattttgaggtaatttattatgtggtaatagataactaagacatgaatatacactaaccctaaaataatctcaaaatcccttcatgttgtccaggtagtaccattaaatgtgacctgcatgttctcataagtgtatgtggtaagaaatgttccatgcatttatttacatgtgtctctagaaaaatattctacagggaaacaattcttctattcctcaatggatccaggtagggcccaccaacactttcatttattctggtggccaggcaagtgcaatggtccatgcctgtaagcccagcactttgggaggttgaactgggcagatcacctgaggtcaggggttcaagcagcctggccaaatggtgaaaatctgtctctactaaaaatacaaaaaaaaaaaaaattagccaggcgtggtagcatgcacctgtaatccagctatgcgggagactgaggcaaaagcttaaactcaagagatggaggttgcagtgagccgagatggtggggctgcactccagcctgggtgagaaagcgagactctatctcaaaaaaaaaaaaaaaattcttctggtcagagaaaatcaattcagcctttagctgagtagaatgagtacaaactgaaaagattattagagagtgaattttattcatgcagacaacacgctcttgacatgagggatgcaggtgtttaggcatatgctatacaaacttccagggcataaaaccaggccagaaagaattttctggtcaaacaagc

SEQ ID NO: 464539 - DNA, 1675 bp, Homo sapiens
agcaaataaatataatatagcatgataattgcaagaatattaacatgtccaaaagttaaagagagaaagcataaagaagaaagtgatgagctctgaggggttgaggcttttgctctctcttaaattgattgctatttagcacccatcaaaagctctgcagaggggaccatcattaacggcatttacgaagacatccacttattccaacagcaggaggaagaccaacgcttcttatcataaacacaagttcctgctatacacaacacatccttgaattctagggaagccaagatgtacatgaaatgactgcaggtcttaaaggtcttgaatctaattgtggcactggggcatatgtagagataaatatcacgtagcatatgctaaggtgatttcgaagatctattctatcttaagacactgtaagtctaattattaaatgagcaatacagacatttacccgcgcggctgcgcgtctcagtccacccctggggcgcgcggctgtcacccagggcggggcggcgcgggcgttgccacgacgcgggccgcgcgcgtccctggcagccaacccgtccacgtcaaggtttgtttaataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgattactgatttatcttacagtctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcggatactgtccatttcactgcagggtatttcccttttatatctgactttgatggcatgtgtaggtgaagtgttcttgtgaaatccctttctacttatggacagattttaagacaggtcatccagacagtgttaagtaaggacaaagtaggtgtttct

SEQ ID NO: 464540 - DNA, 1656 bp, Homo sapiens
agcaaataaatataatatagcatgataattgcaagaatattaacatgtccaaaagttaaagagagaaagcataaagaagaaagtgatgagctctgaggggttgaggcttttgctctctcttaaattgattgctatttagcacccatcaaaagctctgcagaggggaccatcattaacggcatttacgaagacatccacttattccaacagcaggaggaagaccaacgcttcttatcataaacacaagttcctgctatacacaacacatccttgaattctagggaagccaagatgtacatgaaatgactgcaggtcttaaaggtcttgaatctaattgtggcactggggcatatgtagagataaatatcacgtagcatatgctaaggtgatttcgaagatctattctatcttaagacactgtaagtctaattattaaatgagcaatacagacatttacccgcgcggctgcgcgtctcagtccacccctggggcgcgcggctgtcacccagggcggggcggcgcgggcgttgccacgacgcgggccgcgcgcgtccctggcagccaacccgtccacgtcaaggtttgtttaataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcggatactgtccatttcactgcagggtatttcccttttatatctgactttgatggcatgtgtaggtgaagtgttcttgtgaaatccctttctacttatggacagattttaagacaggtcatccagacagtgttaagtaaggacaaagtaggtgtttct

SEQ ID NO: 464541 - DNA, 1447 bp, Homo sapiens
agcaaataaatataatatagcatgataattgcaagaatattaacatgtccaaaagttaaagagagaaagcataaagaagaaagtgatgagctctgaggggttgaggcttttgctctctcttaaattgattgctatttagcacccatcaaaagctctgcagaggggaccatcattaacggcatttacgaagacatccacttattccaacagcaggaggaagaccaacgcttcttatcataaacacaagttcctgctatacacaacacatccttgaattctagggaagccaagatgtacatgaaatgactgcaggtcttaaaggtcttgaatctaattgtggcactggggcatatgtagagataaatatcacgtagcatatgctaaggtgatttcgaagatctattctatcttaagacactgtaagtctaattattaaatgagcaatacagacatttacccgcgcggctgcgcgtctcagtccacccctggggcgcgcggctgtcacccagggcggggcggcgcgggcgttgccacgacgcgggccgcgcgcgtccctggcagccaacccgtccacgtcaaggtttgtttaataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggcttaaatctcttcaagctcaggaggatgcccgccacagaaacacagatcagaggagctcagagaataggcggtcagagccttggagcttggaggagcggaagcggatactgtccatttcactgcagggtatttcccttttatatctgactttgatggcatgtgtaggtgaagtgttcttgtgaaatccctttctacttatggacagattttaagacaggtcatccagacagtgttaagtaaggacaaagtaggtgtttct

SEQ ID NO: 464542 - DNA, 594 bp, Homo sapiens
ctctctccagctctgggagacagttggagcctcagcgctattcaattttgaggaattttcacctagaggaatccaagatcttcagtccaaacagcaatttctggggagttattacttctctaaaacctttgtgctgggaattaacaagagttcttcaatctaatcacgctctttggcatcaaggtctcccaattctaaagttaccattgcataggctgttgcataattttagacgtcatggagagtcccactgatgaaatctgagaaggctcatgtcagaccactgactgctaaagacatcactacatgaaagatcagtagtgtgaaactttaaaaacatcgatccaaatgaatcaattaaatcaacattcatccctcttaagtgtgtggtttaaaactatcattgttgcttttttaaaaaaaccttacatagattttgagataaatgctggaatgctttgatggctacttctattctcgaatctccgttaatcgactttgtgctattcccctcttttcaacatcttccacttggtgtacattctttacttttagtacagtgcatgacagttgcaatgctttaaatctaaaacc

SEQ ID NO: 464543 - DNA, 1326 bp, Homo sapiens
ttgtgatttttctgagatttttttttcctatcgcctgtcaggaggcgtctgggcagccttgtaaactcagagtgacttctcatatcgtgctatgttttcccagcgatgcgctttcctctgcgctgaagccctgggaatcatttcagcccaagaattaaagcggctttttagcaccgttgttctgaactatttgtgggcatttgatcagtacagtgctggtaatgttattattgcccttgttttcgtcacactttttctctttttgattaagatattcaaaacacttttggagggattcctttgtgttgaagcacgaagagagaaaatcagtagttctaaatttctggtggaaaaaattaagataagccaaaaagacctgaatattgttttcatgaggcaaaataaaggagtgttaccaaagcctttaattatgtcaggaaagactgaaatcatggtatttcttttaatggggataactatcttttgcaacctctctgtgtaatttactgatgcaaagcaaaagcaaaaatggggaggggggaggggaggaaccaacaaaaccaccacaacaaaccatcaatatttcttcagttgataaatcctgattatccaagtacccagagaaggtgtgaacatttattggaaaaaagccatttatttaattatggctaaaaaaagaagaaaataaacctttgaaaaattatttggaggtacatgaagatgaactggatcagaggcacctttttcagacacaatgggatatggtgacatattcaattttgaggaattttcacctagaggaatccaagatcttcagtccaaacagcaatttctggggagttattacttctctaaaacctttgtgctgggaattaacaagagttcttcaatctaatcacgctctttggcatcaaggtctcccaattctaaagttaccattgcataggctgttgcataattttagacgtcatggagagtcccactgatgaaatctgagaaggctcatgtcagaccactgactgctaaagacatcactacatgaaagatcagtagtgtgaaactttaaaaacatcgatccaaatgaatcaattaaatcaacattcatccctcttaagtgtgtggtttaaaactatcattgttgcttttttaaaaaaaccttacatagattttgagataaatgctggaatgctttgatggctacttctattctcgaatctccgttaatcgactttgtgctattcccctcttttcaacatcttccacttggtgtacattctttacttttagtacagtgcatgacagttgcaatgctttaaatctaaaacc

SEQ ID NO: 464544 - DNA, 1507 bp, Homo sapiens
tcgttttaagactagtcaagtgcagtagtgagaaaggggaaagagtggaacaaggagttcgatctgtaacggactgaacaagcaacagagaaaactcactcccttggcaccagccacgagcacattcttgaagccaaactcatccatccgtactgggagatagatgatcatagaaacatcaagtgtgagtctggtttgagtttaaaacgaaaagtgctttagagttatggaaacttagcttcaaagaagaggcaccaaggatgccgcgcgaaaactcacgaggccacttaacacaggctgcgtgggaaacaggggctccgcgactgcgctcagattaacggaaaaagacacccctctagagtccggcagcagcgggcgggcaccggcgccttctccacacaggagaatctcggcgatttacacccccaggctacgcagaaaaagcggcttcggaatccgccgcaagtcccctcctcgggtcgccggggaagtctggcctcccgcgtctgggtccccttcgggacgccccaaggccccgtttaccacggcgactccccgcctctcgcgccaccgaaccacggcgcggggccaccagggcgggcctcgcctcgtgcggaaaagtcgcctcgacgggcggcgcagacggcggaggcagggggacgtagtccacgcgcccagctcggagcgcagggccccgcgcccacgaccgcccgcgccctccacgtgccgcgggcaaagctcggagccggtgcgccgaggaatgggcagcgtggacaagagaggagggggcggcggcgcgctccgcccgggctcggtacctgagcgcggccgcgggggggcggagcgagaagactgccggccgcccaggccccgctcgctcagggcgacgcgcctcagccgcggcggaacaaaaccgcggccgccgccccgccccctccggccgccctcattggccgcccgcgccccgccgccgccgcgagcccgtcagccgccgccttctccacgccggccctcagccgcgccgcgccgacggagggggcggggcctccaggcgcccaggctcgcaccgcccaccgagtccgcagcgcgccctgtgcgagggtctggccccgcccccggatcgacgccccgccccctgcgcgcgtgcgtgcctggcactcggcggcgtcctccaggcctagaaggcaagacctgtggcggcggcgacctgaggcggcggggcaggacgcgcagaggagggcccggtcgctcgccctctcgggtcgcacttctgcacctgcacagtgtgaattaggccctcgctcatggcaaataacaagtggatgcgcgagtctggggggaatggggagcaactgcctactgggtacagggtctccttttgaggtgatgaaaatgttttgaaactagatagagggagtggccacacaacattatgaatgtatcaatgcactacgttgtatgctttaagtggtttattgtatattaatttcacctccataaaaactaa

SEQ ID NO: 464545 - DNA, 445 bp, Homo sapiens
gttcatgagggatctgcccccatgacccaaacacctcctaccagaccccatctgtagattgaggattacatttcaacatgatatttggaggagaaacgtcatctaaactttatcagagagaaatgaatgtaaactccgcagaagtatgtagactctgctacaagatcatagttcacctcaactactttatagataacaacttaaatattaaggaaacattaagttttccctttgaaatattgtttcaggtcctgcatgccagtaaaactactcatgtcagctgttctgcaggatcccatgagaagcctctcaccctccacaatccccttaaaaactgtagcccagaactctctggaatgatgaatttgaaggtttgctcctgtctcctcactcagaagcctgtaatcattaaactctttctctgatgcaaactctgctgtctcag

SEQ ID NO: 464546 - DNA, 393 bp, Homo sapiens
cagtggtgcttcaggatattgtgaatttgggcttctgaaagcagaattctgatttaacagtataatggaattcgtgaacgtcatgatgctaatttgaaccaacaagcacccttgtgagaggattctgcttttcctcaagtctgaagaacaccaggagaatctttctgtatggagttaccaggaatcctctgctaaggtcctgcatgccagtaaaactactcatgtcagctgttctgcaggatcccatgagaagcctctcaccctccacaatccccttaaaaactgtagcccagaactctctggaatgatgaatttgaaggtttgctcctgtctcctcactcagaagcctgtaatcattaaactctttctctgatgcaaactctgctgtctcag

SEQ ID NO: 464547 - DNA, 1116 bp, Homo sapiens
ttgagtgccacctccaccactcaataaaacccccacattcaccatcctcaagtctgtgtgcaacttaattctttctggatgctggacaaggaactgggtaccaagagggcactgaacaggttaacacttaagccgtctgtggatggcaaagttaaaagagtgcactgtaacacatgcccacttgggctgtgggagtcgcaggaacccacccctagacagtaccatggccacttgccctgcctattgcacctgcctgtctgcatgctcccctgcccaacggagattcactcttgttgcccaggctggagtgcaatggcacaatttaggctctccacaatctctgcctcccagattcaagctattctcctgcctctgtctcccaaggagctgggattacagatgaaagcaccattatcaagtcagaagagcacaagtcaaaccactgtaagttgaggactctctgtactttcttaaatgtttgatagaattcacctaagaaagcatgtagcctgtaagtatagaaatctttttaaattaaaaaaaattcttcaatacatagagaagctattactttttctatttcattttgcatcagttttaagaattagttttacaaataatttcccatgttattttaattgtcaaatgtattggcctaaagttttcataattatattgatgtctgtaggttctgtagttacatcttctatttaattcccattatctacattatgtagcttctctaaattttttcgagataaatcttgctagccattgtttattaaaaaaatttttttcaaagaaccaatttgtgggtatattaattagctccaccttttgttatttgctatgttgttggtttacatttttatctttatcatcttccttcttcttaatttggatatactttgctcattttttagcctcttaaaaaagaacctaaaggtcattgattgaagccttttattttcagtatattacatctataaatgtacctttaagaaaagatttatctgcatcccccattttattaagtttttaaaaattttctttcaacttaacctatttttttttttgcgtgtgaaaactttttttggccaatgggtttttctgaag

SEQ ID NO: 464548 - DNA, 996 bp, Homo sapiens
tctgaactctcgggcggcggcgaggacggcgtgtccactgtcgaggcatgaaggctgctgtgctggaccttgggtctctcttggccaaactcttcgagacctcgacggcgccccccgcaggcccctcctccagaccctcgggaggtgctgccgctgcagggtcggggggctccagggcgggcaccccgttgggtaccgccccgaccctcctccgcgccctggctccggactccccctccgcctcgcggcggtcgcccgccccgctgctctcctccccctactcccggggctccgccgccagccgcgccgcgggagcagtggggaccctgctctcttggcccagtagccctagagcgggtaaagccccgccccagccccccactccctccggcgggggctgctcccctgctcgcctggtggtcccagcgcggccgccctcgggccccggcggggtctgggccgcgctccccaggaacccgctccagcctggccccggagagcgagagctcggcgcctgcgtggcccccggggctggccccagaaccctgttccttacgctgcctgacatcggcgaggagggggcctcggacggcgactccggggatggcgaagcgttggagtgcagtggtatgatcactgttcattgcagcctcaacctcccaggctcaagcgatctgattctcccgtctcagactctcgagtagctgggactacaggtgtgagctactatgcctggccaattttaaaaatgtttctgtggagacggggtctccctatgttgcccaggctggtcttgaactcctggcctcaagcaatcttcccacctgggcattgctgggattacaggcatgagccactgcatctggccatgaaattgaattttagaagaggactgtcagaaggacgtagaaggcacggttttactgtgaggagcaaagattctttacctacgcattttacaagaaatgtgcagaaagccattgataaatatacctg

SEQ ID NO: 464549 - DNA, 1068 bp, Homo sapiens
tctgaactctcgggcggcggcgaggacggcgtgtccactgtcgaggcatgaaggctgctgtgctggaccttgggtctctcttggccaaactcttcgagacctcgacggcgccccccgcaggcccctcctccagaccctcgggaggtgctgccgctgcagggtcggggggctccagggcgggcaccccgttgggtaccgccccgaccctcctccgcgccctggctccggactccccctccgcctcgcggcggtcgcccgccccgctgctctcctccccctactcccggggctccgccgccagccgcgccgcgggagcagtggggaccctgctctcttggcccagtagccctagagcgggtaaagccccgccccagccccccactccctccggcgggggctgctcccctgctcgcctggtggtcccagcgcggccgccctcgggccccggcggggtctgggccgcgctccccaggaacccgctccagcctggccccggagagcgagagctcggcgcctgcgtggcccccggggctggccccagaaccctgttccttacgctgcctgacatcggcgaggagggggcctcggacggcgactccggggatggcgaagcgttggagtgcagtggtatgatcactgttcattgcagcctcaacctcccaggctcaagcgatctgattctcccgtctcagactctcgagtagctgggactacaggtgtgagctactatgcctggccaattttaaaaatgtttctgtggagacggggtctccctatgttgcccaggctggtcttgaactcctggcctcaagcaatcttcccacctgggcattgctgggattacaggcatgagccactgcatctggccatgaaattgaattttagatccacgactactcacattcccttcctctcatcataccccactcctttttcaatcactaaaacataagagacaaaggggaaggaagaaagtattaagacggcttttctttcaatactgcagactttgcaccttgaaggattctttttccctcctggatttctgtggtagtgatttataacacc

SEQ ID NO: 464550 - DNA, 820 bp, Homo sapiens
tctgaactctcgggcggcggcgaggacggcgtgtccactgtcgaggcatgaaggctgctgtgctggaccttgggtctctcttggccaaactcttcgagacctcgacggcgccccccgcaggcccctcctccagaccctcgggaggtgctgccgctgcagggtcggggggctccagggcgggcaccccgttgggtaccgccccgaccctcctccgcgccctggctccggactccccctccgcctcgcggcggtcgcccgccccgctgctctcctccccctactcccggggctccgccgccagccgcgccgcgggagcagtggggaccctgctctcttggcccagtagccctagagcgggtaaagccccgccccagccccccactccctccggcgggggctgctcccctgctcgcctggtggtcccagcgcggccgccctcgggccccggcggggtctgggccgcgctccccaggaacccgctccagcctggccccggagagcgagagctcggcgcctgcgtggcccccggggctggccccagaaccctgttccttacgctgcctgacatcggcgaggagggggcctcggacggcgactccggggatggcgaagcgtgagtagcagcgtggtccgggcgcgtgtaccttttgccgggacccccgacccctccgcctgccgcactcaccttcgcaggtgcacttcaggaaatgaaatatttgtagtaactttcataaccccctgggcaccctccttgcacgtttcctgggtttttactccttggctttgcgggctttcagacataagctgtgacatgctttgt

SEQ ID NO: 464551 - DNA, 4015 bp, Homo sapiens
cagccaaacacttcacccacccatgaccctccaactgtcccgctacagcaggggatgggggttgtcttccgatcgacctcggggggcaaaggcaaaagtccctagctgcttcggaaccgctcctcgagtcctgaagccgctccacgcctcctcgcccaccacttggtccccgcaggacgtggcagtctcgggctccagcctggaaaggagcccgcccgggtgccgtcacccgccccgcgcggcctcacctgccgctccccggaaatctcagcgctgccctgcccccgcccccaccctcccgcgtcctccaactcgaggccgcgacttccgccttcctgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaagaggtcctggattttttttttttttttggaggaactaacattttaagttacattatgttatgcaagttagaatttcagttacagctaagcatacttgtaaaatttcaggactgtatctctcagaacctaaggaccactgagaatgtttatggaccagtttgaataacacttaatgctattcttttagattatcagtctctacttggtgccagtgtgagcaacacattataactcaaggcactgaaattattcagtgttaagatatatctataatatgtttggttttctgcaatcaagctgttcatggaaagaatttatgtacatgttttacttagggtcacattttagagtaaaagtattgaagcaaaggatatagtcataattctcagttacctactaaagttatggtttcatcagttctgttgtaacaacttaaaggtatttaaaggtctgtttttctataatttattagtcttaacacatgccagttttgtatttgtttgacatatgctttttttttccacttttttccatcatttagagagcctttctatatatgtgagattcatactttacagtgtgtgtgtgtgtgtgtgtgtgtgtgtgtgtgtaaggggctggagtatagagaatattgtgaggtttgggattcttcagaaaaatcacctctcactgcaacagagtactgttgttaaagaatcccatttgctattatctagaatacttttaagaaattgtttacttattacattgtttctgaagttctgagaactaagtacaatcaattaccattctaaagctggtcttgggggagaaagaaagctgtcccctggctgcctctaacaaacattttatcaaaaatcagcaaataaataaaagtttgtatgtcagaacttgagccatagtatccatgataactttcagcatattactagttatcagatatataaggacattttaaattttacttgtttataataagcaaactagaaataagcacaggaggccgggtgcggtggctcatgtctgtaatcccatcactttgggaggccaaggcaggcagatcacaaggtcaggagttcaagaccagcctggccaacatgatgaaaccccgtctctactaaaaatacaaaaattagctgggtatggtggcgtgcacctgtaatcccagttactggggaggctgaggcaggagaattgcttgaacccaggaggtagaggttgcagtgagccaagatcatgctactgcactccagcctggcgacagagcaaggctctgtctcaaaaaaaagcacaggaagctgtgggctggaaacctaatgttgaaatagaccttatattttatatggttctaagttggaggcaatttgatcctatttaggaatgattgcttttatatttgctactggttatagaatcatgctgatttacttcatatctggaataaatatttaaggacaaattctgcatttctcaaacatattaaaagggatcacatggtcaaatacccaaagtttgggaaacacagactatatggtaaacatttgcaaaaggtgtatatggaatgcaattaatgagataacaggaatttggcagtagaaacactagtgtgttaaaacatttacagttttctctacaatccagtctaggagttaagaacatcttaatctcaattcacagtcccaactatatcaca

SEQ ID NO: 464552 - DNA, 2134 bp, Homo sapiens
tgcgcatgctcagctcagctcggccctcgcctttgatttattttttttctgggcggccgctgcgacccgggactgacttcgggatgggaagtggagcccccggagctgctaccgtggcggcggcgctgtgaggagcagccagggggaggcagctgcggctcgccggtgagtatccgggaagcgccaccatggggctccgtaagaagagcaccaagaacccccccgttctcagccaggaattcatcctgcagaatcatgcggacatcgtctcctgcgtggggatgttcttcctgctggggcttgtgttcgagggaacagcagaagcatccatcgtgtttctcactcttcagcacagtgttgctgtccctgcagcagaggaacaagccacgggctcaaagtccctctattattatggtgtcaaagatttggccacggttttcttctacatgctggtggcaatcattattcatgccacaattcaggaatatgtgttggataaaattaacaagagaatgcagttcaccaaagcgaaacaaaacaagtttaacgagtctggtcagtttagtgtgttctactttttttcttgtatttggggcacattcattttaatctctgaaaactgcctgtcagacccaactcttatatggaaggctcgtccccatagcatgatgacatttcaaatgaagtttttctacatatcccagttggcttactggtttcatgcttttcctgaactctacttccagaaaaccaaaaaaacaagacatccctcgtcaacttgtctacattggtcttcacctcttccacattactggagcttatctcttgtacttgaatcatttgggacttcttcttttggtactgcattattttgttgaattactttcccacatgtgcggcctgttttactttagtgatgaaaagtaccagaaaggcatatctctgtgggccattgtgtttatcttgggtagacttgtgactttaattgtttccgtactcactgttgggtttcacctggctggatcgcagaatcggaatcctgatgcccttactggaaatgtaaatgtgttggcagctaaaattgctgttctgtcgtccagttgcacgatccaagcctacgtaacatggaacttaattactctctggcttcagaggtgggtagaagattctaatattcaggcctcatgtatgaaaaagaaacggtcgagatcttctaaaaaaagaacagaaaacggagtgggagtggaaacttcaaatagagtagactgtccgccaaagaggaaagagaaatcttcataatctttgcaagcgcattgattaatgtctgcaaaggaatctgctctttgaggtttctttctgcactagagatttttctgtttttgaaaatagttcgtgctcttcggtttttgttattgaactgtttcatgtattttttaaagacatttgaggggaggaggattattatgaatgggaaaaaaagattttggttgagactaaattactcatcgtcaaaataatgtcaaaatagttttggggatcaccactatattttgttttgatttttaacctttcaacattttcctaatgatttgcagagataactgcacaattttgcatatcaatgatactggttcttactcccaccagtgtttcataatactaacaagatggtctctcctagcaagattatgtgtttaatgcttgctttggggtaaaataaaagtacgaaaaaggtggaagtcaaatcagtattctgtaattgttagaatttattttttaagaacttacaactcagaaaagattgctagactcaccaaaataataaatgttctttattttacagagctctatggcagttaaagaagccatttaatcctacaatacttttattttgtgatggttgtctccatttagtgtactttagcctgccataaaagagattttatttataacaaacacagattaaggggaaaatcctaaaattcacatgaaatttgaagggatcttgaatagccaaaacaatctttaaggaaagaaaaccaagtttaaaaatctcacaattccttattccaaagcatattacaaagctgtagtaataaaaacagtgtggtactggcataaaaagcagacatat

SEQ ID NO: 464553 - DNA, 2333 bp, Homo sapiens
tgctagctctctaaaggaatgaaaataaccttgggttctcactaagcatcaattctgtgactggctctgtggggtagagatgaaaaggctcactcagttccagcccctgcagatcccccaggaccctggcagcagcagatctatgagcccacatttccccctgcttgtgaggatcacaccaagagagacattcacatcctggcctcacaaagaagagatggcaaagtggaaaaaggccggagtccccaaccctgagccctttaccctgtctcagtcttttataacgaggtgtgtgtgcttgggcaatgcctctctcttctgggactcagtgtacccatctctgctgtggggaggttggactagatgagagtttcccaaactccagttgtttctttccctccctccacacctggagatcagaacacctgtactaaaaagtactgaaaatctttattcaaatgagctcactttttttcaaccaaaataaacttattttagagtgaaactttattgctaccataaatgggaaaaaaatggatctgctcagcactggtatcctgcctgctgtgtgtccagggaggtggctggtaggggctgcaccaatgggctccctctccctctggcttcatgttaggtttggccaatgagaagctctggtttccctgtacttagagcgtggactgtgaacccccaagcagacgctgaccttcttagatcactgtgggtcaaaaccactctgaggggctggccgttggactgttggagctcagtgtaagcaaagtctcttctctcagcagcttttctgggagactgaaaattggtcactattcctagaggtctacttggtactgactctttatttcttgcctaaatgtcttgggactccgtgctgtggtagatgttagcaagggagtcaaccaaataaagtcctgtgggcctgcttccatcctgcctctcatagaaccctcacagccactctgggacatagccaggcgcgccgaggaggcttggagtagcagggctgatcgatgccgggaggctccttgcggctgccagagccgtagtcatgggtgggggcggctgtgggctctgcagcagcggctctctgtgtctctgccctgctgctggcagccagagttccagacagctccctgccctccagaccctcagcccagagtcccagagcccagggcacaggagaggcctgctcctgggttacagcttgcctggtacacacccaggaggggctatggctgtttcgattggaggaggaaacagctcagagtccgttcctgctcattccatgaagcagcggcaggacttggctctgccaaaactcaaggctctgttctgggctttccactgcctgggcttattcaaccctcacacaagtggatcagagaggagaagcaactggccagtgtcacacagccagtacgtggtcaaccagcttcctgccgaccgccaagccaagattcttgagagatctcagcagggcaagcccgcaaggccggacctggtgcacagtaggctcacagacccacaggggtctcctggctggcaccctgtgcttcctggttttgtaggctccgagaatgtccaggtattggaagctggggtgttgctgggtggcccagcaggggctcagggcagagctagtagagggcagtgcaggggtgtggcccccatggccccccaccagccccagcccctctgctctccaatactgtgctcctaccacctggtggtttcttgcacagaaatggtgcactgttcagcaaggcggtacagatgaaactctgaattgaaaggcctgtgggaaagcctagcacaagctacctctcccaccttccccttggttctgtgttatctcaaatgtcttcttctcaaagaagccctccagaatccaggagcgtgcatggttgggaggcgtagaagccacacttctttgtattccctccaaattttgtcacttaagaacacaaagcttgtgacattaggctacatgtataacttgtgtcatccttcttaatcttggtaacaaccaatgaaagtactgtaattacctccacttcacaggaaaccctggttctcttttgaaactaagccagggaggagcaaacgccaaggaattcacaatcctgtctgggactttctgttttcctctttgaagaaatatgagcttttttgattgctactaaagtgatgcttaaccgttctacagtgacagcttctccctctgcatctgttatatggggcatgctactaaaaatgttctaagaactttgatttcaaagccttggcatctcccttgaagaaatcagagacacatt

SEQ ID NO: 464554 - DNA, 1092 bp, Homo sapiens
gttttggacactatcagctattgggatggctcctcagttagtaacagaagctctcaacacacatgtgctcgccaagaaccatatcaacgatggcagcatcaccagacttcaagaatttagggtcatcttccagctttttaccagaacagatatcaatcttttccttcagctcagcaaagttgcatgcaatgtgagctgtgtggcaatccagcacaggggcatagccagtgctgaactggcccggatggttcaggataagcacctgagcggtgaaaccagctgcttccactggtgggtcgttttttctgtcaccagcaacgttgccaggacgagcatccttgacagacactttcttgatattgaggcccacattgtccctaggaagagcttcactcaaagcttcatggtgcatttcgacagattttacttcagttgtaacactgaccggagcaaaggtgaccagcataccaggtttgagaacaccagtctccacttggccaacaggaaaagtaccaataccaccaagggcttgtcagttggacaagtttgtggggctcttgggcctttggccacagactgaaggctgcactgaccattttcctacttttgaggttttgggacttggactgagccgctactggcttccttgctcttcaacttgcagacagcctgtagtgggacttcaccttgtgatcatgctgctgactaacttaatgaactgaacggattaaaatggtgcaagagaaaagggcatttttacacaaaaggaagcattttctgtgttccagttcagctgttccaatgacatttggtggtgttatcagtgtgaattatacaagcaagtttctttatccagactgacgcatcaaccatgatctagcatttgcaagatgtgtaattactttgactttcaagaaaacatcttctgatctaaggaacttcccaagatatcaaagctggctggctcaggaatactctcacagtgatggcagaagagcaaatctggaagttcaaacactcaaatgtgttgttggatttctgcatgcatcacatgggctaacaactggtcaaagcaaatcacatggccaaact

SEQ ID NO: 464555 - DNA, 669 bp, Homo sapiens
gagctaaatatggggacttcaaacagaagcacagcttgtccccggccaagcagccaatcaaatttccccaaacagcagctgtttcggtggaatttggtgaaaaggcatatagagggcggctttgaaggaaggaactggagggtaggagctggtaagaggcctcacgctgctgacaggctggtggagggaggcgcttggcttgctccctctgagtcactgccattcccagtcacatggtgtaagcagcttggctttgccccaagaacctggtgggggcagataaggagcctcccatcatgcttgagtccagcctcactctctggaaaagtctggcctcctgcggcagccaagcatggcaggcctctgccaacagaggttaagccaagcatcctcagaccatgtcccagctccagttcaatctgacctgcgtgccgagattagcagccagctagtggagtgaaaagggatctcctcaacttgcttcccttttgccttcctcaaaggaagagctaagaagaggaggccaggaaacagctcctaccttaagtgcatctgatgacaaatgactcaaacaccactttgcagaagtaaaggtgctaggctgagtctttgtaacaactggacccagaagggcactgagaaacacacagctgctttctgttgaagact

SEQ ID NO: 464556 - DNA, 375 bp, Homo sapiens
gattctgaggcctccccagccacgtggaactgtaagtccaattaaacttctttttcttcccagtctccggtatgtctttatcagcagcatgaaaacaagactaatacacccccacaccatggtaccgaagacgggacacagctgctctactgattaaattcaactgacgtgaggttgcagctattctattcatatattcaccatcccattcttgatgatgttcctcaagcttacttaacttgcacgtggatgcagaagaaaggtttcttttgaaagactgttgtaaataaaagagtctgtagtgcttatgttgttgtttgttgactgactataaaatagatccttgctgatttgtacatttgatttcccatgggg

SEQ ID NO: 464557 - DNA, 822 bp, Homo sapiens
catcccagtataaaatgctttctcataccagcttgctagtgcttcacatgccagcaacaaacggaaaaaccctccatttcacaattccaacctcatgcatgatacttgagtatctcagatcccctttgactttaaaattcaaattaggttacacaccgctggattcagcgtgcacccaggagccagcatttaacagcagtggtgaacacagacacacgggggctgtagggtggtggaatgggggttgtgtgccctggatttacaagaggatccccgaagctacagaatcacagatgacgcggagctgcgtgaaggcgtctctgggcgagtcccacagggaagatgaaaagcaagcggcccggaagggcccgagggcggagcgcaggctcacgggacacagcgcgcaccaatgatgagcaaactgaaccagcgtcaggaggcgccagttaaactcaaatgtttcagctcaacaaggcctgtgaggtggttcctatttctccagttttacgttctccggtatgtctttatcagcagcatgaaaacaagactaatacacccccacaccatggtaccgaagacgggacacagctgctctactgattaaattcaactgacgtgaggttgcagctattctattcatatattcaccatcccattcttgatgatgttcctcaagcttacttaacttgcacgtggatgcagaagaaaggtttcttttgaaagactgttgtaaataaaagagtctgtagtgcttatgttgttgtttgttgactgactataaaatagatccttgctgatttgtacatttgatttcccatgggg

SEQ ID NO: 464558 - DNA, 828 bp, Homo sapiens
  misc_feature (1)..(1): n is a, c, g, or t
  misc_feature (53)..(53): n is a, c, g, or t
  misc_feature (213)..(213): n is a, c, g, or t
  misc_feature (218)..(218): n is a, c, g, or t
  misc_feature (226)..(226): n is a, c, g, or t
  misc_feature (235)..(235): n is a, c, g, or t
  misc_feature (248)..(248): n is a, c, g, or t
  misc_feature (253)..(254): n is a, c, g, or t
nttaaatgttagctatagcaatcaaacgcacctattagctgatgtcagagcgngactaaactatcgtgctgtacaaacaaaaagttttttttacgccctttattatcgggtctgtctggtaatagcgaaaattctgataactgatagaaatattatttttacagggacaacttgtataaaatcactctacaaagaaaacaaaaatttgccttnacatnaaccagtncctaaggancagcccgattaantccanntgtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtgtgttttgactagtaaaaatgtttttaaaatattggtggttttcaac

SEQ ID NO: 464559 - DNA, 2046 bp, Homo sapiens
tgccagttcaaccagcgacaaagacgataactacacccacaggatggtcctcagaaagttacggcctgtccaagatggcatccaaggttacgcaagtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggcaagtgtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggggctcaggcccagggagatccaaattctgtccctgagcctctagctggagttattggagatcctccagggaagccccgcccaatgaggaaggatgggtcaggtttaggcctgaagaggccctttggccacagactgccacagccgatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttagacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatggagtatacaaagaggattagggctagaacctcaaggaacactcaaatattggatttggaaaaataaggaaacatggagttatttgacaggtaagtgtagagtgaggatagcacaaagagaataaaataagcattctaaagtgctgcagaggggtcaaggagaatgagaactataaaaataacttttgatttggcaaccatgagttcactggtgtctaaaacagcagttcgcaaacctggttgctcgggagaagcaccactccaagatagtctgagcaaatcaggggaaagttcccaaatctgcattttgacaagttattacaggtgatttgatacaggtggtactttgtccacactttgaaaaataccaccctgcagaataataataaaaagtagtatcagaattgagattggccatcattaaggaatgaatggaagatgagaagttgtaggcaatgtctgcattctattcttcctagcagtttggtgatgagaataatatggttaggatgttttaaatgtttgtttaaagtgctgggattacaggcatgagccaccatgcctggtccataaattttttaaaaacacacaaaaagca

SEQ ID NO: 464560 - DNA, 2942 bp, Homo sapiens
tgccagttcaaccagcgacaaagacgataactacacccacaggatggtcctcagaaagttacggcctgtccaagatggcatccaaggttacgcaagtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggcaagtgtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggggctcaggcccagggagatccaaattctgtccctgagcctctagctggagttattggagatcctccagggaagccccgcccaatgaggaaggatgggtcaggtttaggcctgaagaggccctttggccacagactgccacagccgatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttagacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatggagtatacaaagaggattagggctagaacctcaaggaacactcaaatattggatttggaaaaataaggaaacatggagttatttgacaggtaagtgtagagtgaggatagcacaaagagaataaaataagcattctaaagtgctgcagaggggtcaaggagaatgagaactataaaaataacttttgatttggcaaccatgagttcactggtgtctaaaacagcagttcgcaaacctggttgctcgggagaagcaccactccaagatagtctgagcaaatcaggggaaagttcccaaatctgcattttgacaagttattacaggtgatttgatacaggtggtactttgtccacactttgaaaaataccaccctgcagaataataataaaaagtagtatcagaattgagattggccatcattaaggaatgaatggaagatgagaagttgtaggcaatgtctgcattctattcttcctagcagtttggtgatgagaataatatggttaggatgttttaaatgtttgtttaaagattacggagatttctgccaggcgaggtggctgacgcctgtaatcccagcactttgggaggccgaggcgggcagatcacctgaggtcaggagttcaaggctagcctggctaacatggtgaaaccccgtttctactaaaaaatgccaaaaatgagccaggtgtggtggcacgcacctgtaatcccagctactcaggaggctgaggcaggagaatcacttgaacctgggaggcggaggttgcagtgagctgagattgcatcattgcactccagcttgggcaacgagcaaaactcagtctaaaaaaaaatttttggagatttcgtgtacatgcatgaatttatagtggagccacctaatgtgatttttacaacttgttttgggtcctaatggatgttagccaggtcagagaattgacccagctgtaattgggtcagctgtgattatagagaatctaggctgatatgaatatattactgaaatggctgaagccaaaatgagggaaataagagtaaagagaagaattgagtggaagtaaagcagtttcattgagtaatgggcagattatgttcagggtattttcagtgtgagttcatagaaatttaaccctggcctgtattttttcatgctcccctccaccttatccccaactgaactcaattattagcagaaatagtacagtagttaaaatagacatgaatgatggcttatgaatggagacttaatagtgggttgttttagcctttgagaggtgtgtatgggccctgagacagctagagccctggacagttaactctggcctcaggcagcctgttatttactccactgtgcaatgccattttcttatctgtgccatggcataaaagacaaatagaatctagaatattcatttgatcttattgaagcttgtttttagtctttgttagggctggtatatttcagatttgtccttattccaagacatgtt

SEQ ID NO: 464561 - DNA, 1728 bp, Homo sapiens
tgccagttcaaccagcgacaaagacgataactacacccacaggatggtcctcagaaagttacggcctgtccaagatggcatccaaggttacgcaagtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggcaagtgtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggggctcaggcccagggagatccaaattctgtccctgagcctctagctggagttattggagatcctccagggaagccccgcccaatgaggaaggatgggtcaggtttaggcctgaagaggccctttggccacagactgccacagccgatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttagacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatggagtatacaaagaggattagggctagaacctcaaggaacactcaaatattggatttggaaaaataaggaaacatggagttatttgacagcacaccctcccacttctgcatataccagaatccacacaatctcaaatcctgcagtcagccctgtagaacccacataaattggctctctctataggccccttggacgttccagtctattgaatgttttatggatttgcttgttctacataattcacttaagtggaataatataatatttgtccttttgtgt

SEQ ID NO: 464562 - DNA, 988 bp, Homo sapiens
tgcctgtaatccctgcactttggaaggccaaggcaggacgtcccagtggaacagtttgtatagaatggggcactctaccagcaaagaagcagtagataggaacccagagagtaagatggcgttgctctcagagtctggagcctggctcagcataggctatttctaccccagccagttcttgctgaaggatggcttctgcagccagttcagcggcccctcctccaggcaacctacctctagggactccaggcagcatgctggctcccctggccttgtgtggtacagtgggttctcacagcccatggggcgtgaggccacgagtcacctacctggccctctggcatccctgctgaaggctctgttcctggcaccaccaggcagtcctcctggcctcatacaaggaccttccccagcttctgcccatcttgggggagctagagaaccccacggcaatggcattggccctgtggacaccaatgatgtgagtcgaggggtgccaggcagctccctctgctgcaaatccctcccactcaccaaactgctgccgcctgcaattccacaatgagcactttagtcatcaaatcataaaatgtcagcttgtaattagccttggaacctgtctagttcaatttcccagctcagagtgctcttggaagatacctgaacgggccctttattttagagtgaattagtggcagagctggaactcgagtctgaccctgcacagtgaaggacgctagaggcatctgcagcttcttcaatgggaagttggggcatcatatgcctttttgaaattatgtgtattggtaggttatatgatgtgtgaattttcttggaagataaagaaaaaaagtaaaatgatgttggatccaatgggaccaagagccaccagcacagtggatagaaacaaaggccctgtactgaatcctgccctgcctcctaattagctaggaccttgcatatgagcatgaacatcagctcttacccc

SEQ ID NO: 464563 - DNA, 1740 bp, Homo sapiens
aaccagaccagttatgcattacgagagccctcatgggacaagaggaaaagattgaggcaaaaagtctatttaaagaattaatggcaggcagaaaatttcccaaatttgagaaaaaatatggatgtagaattgttttaaaacacaactactgtacactgaaatcaattcaaaaattttacaccaataaatattataatcagtctttcaaaagtcacagacaaagaatattggaagcagaaaaagaaaaaatggatcatgacataaaagggaattcacatgatatcaacaagatacaagaggatatctttttaaaccaaaaatataaagagaacattataaagttatcaagaatttatcatgatcaaccagtgaagcccctggatcgagcagtcttctggattgaatttgtcatgtgccataaaggagccaaacaccttcaggttgcagcccgtgacctcacctggttccagtaccactctttggatatgattgggttcctgctggactatgtggcaacttcttgctttggctatgcagacttcaagctgagaatcaaatcaagaattcaacccttttcacagcagctgaatcaaaaagaaaaagaaaaacataaaatacttagaaatatacccaaacaagaagcccagagaaaggagctgttctcccgcgtccccggtgcccctcccctgacagcacaagggaacccggaggggttgcaggacggttccaggaatggcgccctttcttcagaaccatggtatcataccttggatccaccacagttggctgaaaccggcagcccaggaccagtggaccagccagtaggacccagaccatctgacctggctgatcatgcaatgagaccacgttgccagtggagatgacaacagccctattctggtcactccggaagctgacccgtctatgcacggaagaaggttgaggaaacagcaagccctgctctagtcacactgggagctgactagtctgtgcatggctgaagcttgaagaatcatcatcagatgagcaaatgtggccagaagtcttagtcccagtaatcttctttgtattattcattatattgctataaccaccatgaaataaaatattttatttttcatccacttttatgtggcactcatttttaacatctacacaaaaagttcacatatttatcttttctggttcattaatcaagctggtgtctatttgattttcctttagctgtaaagagaatgttatgtagttatcaatcatttattatgatcagtctctgaagcccttggaccaaaaactcttctggattgaatttgtcatgcaccacaatggagccaagtacctgctgccacctgcccacaagctcacctggtttcagtactgctctctggatgtgctggcctgcacagctcttgttactctctttgtcatactatgatgcttgattatcaaaagtttgttaagatgagaaagaaggaaaagagagtaggtctgtttgagatctaaggcaggcaggcatgataccaaaaattgtgccatttaatgccaccactatgcatcaaggtatggactaaattctttattacattttacaagacctgtgccttcctgatttgtttgaattttttaatctttgttaaacataagtattgtaaaattttattttcagaaaacctataataattcaattttaatgcttatctgtgtatatttttcagctgaaaataaaatgagtttcactgg

SEQ ID NO: 464564 - DNA, 381 bp, Homo sapiens
acgtaattagtacccgcctatgcatctaactatcctaccagggccctggtctgcccatggacattctctgcacacagctattatggtcagtacctgaaagctcagtccctctcctgttctacacaaacaccaatgtctccccagtgcctcacacaccaacttgagactcctgagtaacacacgcatctgcattttcaatcaacgccttgagggactgaatcatctgcaaagggaacatccagacatgagattacacctgacaactagatcccctcctgcattcatgcacaaggctcttctcctaaaacaggctgatgtgatgatattaaacgcttttttatctgactttcaaaaaaaaatactacggcctccttcgcctta

SEQ ID NO: 464565 - DNA, 1350 bp, Homo sapiens
agtctgagcagtcactcacactctccctctttggaactggtaatgggcaaaagttggaacagtttggagagctcagaaaaagacaggaagatgagggaaagtttggaacttcctagagacttgttaaattgttgtgaccaaaatactgatagtgacatggacaatgaagtccaggctcaggaggtctcagatggaaatgaggaacttattgggaactggagtagaggtcacttttgctatgctttagcaaagagcctggctgcactgtatccctgctctagggatctgtggaaccttgaacttgagagtgatgatttaggatatctggcagaagaaattcctaagcagcaaagtgttcaagatgtagcctggctgcttctaacaacctatgctcatatgcacaggaagagaaatgacctgaaactggaatttatatttaacagggaaacagagcataaaaagaccttcctgacagcccctcctatcacagacctgaggcctaggcaggaagaatggtttcatggaccaggtccagggcccagctgctctgtacagcccctggacactgctccctgtagtccctttcttttggctgatttctccctttcgaaacgggattatttactcaatccctatatccccattgtaacttggaagtttccatttgcaaatataattgacccttcaacaacaggggtgttaggggcattgactctgcatgcagtcaaaaatctgcatgtaacttttgactccccaaaaagtttactaataatagcctactttggacctgatggatgctttactggtaacataaacagttgattaacacatattttgtatatgatatgtattatgtactatattcttacaataagaacagtccttatgctggatttctttatcctgaaatagcagtcaactgcagacctcaatctatggtatatactaagcaattcaactctttcttaagcaccttccttatctattgccaactgcctcccatcaggtctgcccatggacattctctgcacacagctattatggtcagtacctgaaagctcagtccctctcctgttctacacaaacaccaatgtctccccagtgcctcacacaccaacttgagactcctgagtaacacacgcatctgcattttcaatcaacgccttgagggactgaatcatctgcaaagggaacatccagacatgagattacacctgacaactagatcccctcctgcattcatgcacaaggctcttctcctaaaacaggctgatgtgatgatattaaacgcttttttatctgactttcaaaaaacaaacaaaaattggcctcgttggtctcagcggagga

SEQ ID NO: 464566 - DNA, 1308 bp, Homo sapiens
agtctgagcagtcactcacactctccctctttggaactggtaatgggcaaaagttggaacagtttggagagctcagaaaaagacaggaagatgagggaaagtttggaacttcctagagacttgttaaattgttgtgaccaaaatactgatagtgacatggacaatgaagtccaggctcaggaggtctcagatggaaatgaggaacttattgggaactggagtagaggtcacttttgctatgctttagcaaagagcctggctgcactgtatccctgctctagggatctgtggaaccttgaacttgagagtgatgatttaggatatctggcagaagaaattcctaagcagcaaagtgttcaagatgtagcctggctgcttctaacaacctatgctcatatgcacaggaagagaaatgacctgaaactggaatttatatttaacagggaaacagagcataaaaagaccttcctgacagcccctcctatcacagacctgaggcctaggcaggaagaatggtttcatggaccaggtccagggcccagctgctctgtacagcccctggacactgctccctgtagtccctttcttttggctgatttctccctttcgaaacgggattatttactcaatccctatatccccattgtaacttggaagtttccatttgcaaatataattgacccttcaacaacaggggtgttaggggcattgactctgcatgcagtcaaaaatctgcatgtaacttttgactccccaaaaagtttactaataatagcctactttggacctgatggatgctttactggtaacataaacagttgattaacacatattttgtatatgatatgtattatgtactatattcttacaataagaacagtccttatgctggatttctttatcctgaaatagcagtcaactgcagacctcaatctatggtatatactaagcaattcaactctttcttaagcaccttccttatctattgccaactgcctcccatcaggtctgcccatggacattctctgcacacagctattatggtcagtacctgaaagctcagtccctctcctgttctacacaaacaccaatgtctccccagtgcctcacacaccaacttgagactcctgagtaacacacgcatctgcattttcaatcaacgccttgagggactgaatcatctgcaaagggaacatccagacatgagattacacctgacaactagatcccctcctgcattcatgcacaaggctcttctcctaaaacaggctgatgtgatgatattaaacgcttttttatctgactttc

SEQ ID NO: 464567 - DNA, 737 bp, Homo sapiens
gggtgtgatcacagctcactatagtctcgatctcctgggcctcccacatcagccttatcactcattctgggggcagccctctggcatgtaatgagcagtcctatggagaggcccatgtgacagtagccatgcgagtgacactggaagtgaaacctgcagctccagtcaagcctttagaagactgcagccctggctgacagcttgacagcaaactcatgagagactctcagcttgaacaactcagctaaactgttcctgggttcctggtcctcaaaaactgttataaaagacattgtggctaccatctctcatcactcactcaaagggaagccaaccaccatgcaatgagaatctcaggtaatgaggacctgagacctgttgtcaatcacgtgaataagcttgggaggagattctccagccccagtcaagcctcagaagacttcagccctaggtgacagcttgatgataatctcgggaggcagaaccacccaactaagccactcctggattcctgaccctgaccctgaccctagaaacagtgtgagctggaattctgtgaagcacatgacctcaagtcttcggataaatggaaacgcagcttatgccggaaagatggaaggctggctgtactaatatcagaaatggaagaggagagacatcactagagatcccatggatattgaaaggataataaaggagtattatgagcattgttaaaatttatgtctcctataagc

SEQ ID NO: 464568 - DNA, 1608 bp, Homo sapiens
cctgcacaaatttgcttgctggcaaccatgtgagatgggactttctcctccttgactttcgccatgattgtgaggccttcccagccatgtggaactcttctttcgtggcaattttcccccaggagggatttccctgcagtggacctcctccccattggtaccttcagccatcagaacacctcgctttagatctgtgggtcccaaatttcatcaaatccaatgaccatttctatgatcactcattctgggggcagccctctggcatgtaatgagcagtcctatggagaggcccatgtgacagtagccatgcgagtgacactggaagtgaaacctgcagctccagtcaagcctttagaagactgcagccctggctgacagcttgacagcaaactcatgagagactctcagcttgaacaactcagctaaactgttcctgggttcctggtcctcaaaaactgtatgagatgaaaaaaaagtttgtttttttaagctgccaagttttgggataatttgttattctaatatattttttaatacctggaaatctctaagcaataatcttttacgcaatcccctttattttgttatgaaaaaagagcctaggtagttcttttaaggtttacttttttgtaaaggttccttttgtatctcttttcactagcagaggtgtctgctatgggtaggattccctctggggttccctttgaccaagcttctgcagccagaagcactgaggagggcactggggtgatgggactgaccctgaggccctgatcacaggactcctaagtaggagttcctctgaggagatatgctaggacctggtttatcaaaccagcaatgggatatctggaaaagccgctggggggctgccaggactgcttctcaacatactgtgtgttaacctgcattaacactgcacgaagcaggaacttagagttttctgagcttggctcagtttgtgtgtaacaaccaggctgaggtttcaggggtggctccatttggggtttaacctgcagaccagaggagggaacaatgaaagactagttgtgtttctgtgtttctgtggtctggaagaggaggtgaagagagcgtaggacaaatcactgagtgttcatgtcaaaatatctgcagactgctcagcttggttgctgttgagctccctagttcagcagcagcaggtcgaggaccaacacttatcctcggataataatgactactatttattcagtcctcccatgtgctagatgacatattaggtgctttatgtgtacaaccttagcaatcctttaagagaggtgatattcccatttgtcaaattttagaaagctagttagacagtccagagaagattagtggtttgttcaatgttaggcttccaataagtggccaaaattttaactttggtacacagttatctttgctaagacatcatatgcattcctaaaaaaaaaaaaaaacactcttcagttagcaatatagtatacttaaaataatagggcttatgagaaaaatggggttggtgttagaattaggaagtaaaaaacctgagagtgtaatacaaatagaaatactagcatggctgaatctctgtaaacatttgccttt

SEQ ID NO: 464569 - DNA, 1481 bp, Homo sapiens
atccaggaatagtaagctggctttgtgtgccactaagctctatattttgtattacctatatggaagccataagatgcatccgtaggagaccctctgctgcaactaaaatcactcattctgggggcagccctctggcatgtaatgagcagtcctatggagaggcccatgtgacagtagccatgcgagtgacactggaagtgaaacctgcagctccagtcaagcctttagaagactgcagccctggctgacagcttgacagcaaactcatgagagactctcagcttgaacaactcagctaaactgttcctgggttcctggtcctcaaaaactgtatgagatgaaaaaaaagtttgtttttttaagctgccaagttttgggataatttgttattctaatatattttttaatacctggaaatctctaagcaataatcttttacgcaatcccctttattttgttatgaaaaaagagcctaggtagttcttttaaggtttacttttttgtaaaggttccttttgtatctcttttcactagcagaggtgtctgctatgggtaggattccctctggggttccctttgaccaagcttctgcagccagaagcactgaggagggcactggggtgatgggactgaccctgaggccctgatcacaggactcctaagtaggagttcctctgaggagatatgctaggacctggtttatcaaaccagcaatgggatatctggaaaagccgctggggggctgccaggactgcttctcaacatactgtgtgttaacctgcattaacactgcacgaagcaggaacttagagttttctgagcttggctcagtttgtgtgtaacaaccaggctgaggtttcaggggtggctccatttggggtttaacctgcagaccagaggagggaacaatgaaagactagttgtgtttctgtgtttctgtggtctggaagaggaggtgaagagagcgtaggacaaatcactgagtgttcatgtcaaaatatctgcagactgctcagcttggttgctgttgagctccctagttcagcagcagcaggtcgaggaccaacacttatcctcggataataatgactactatttattcagtcctcccatgtgctagatgacatattaggtgctttatgtgtacaaccttagcaatcctttaagagaggtgatattcccatttgtcaaattttagaaagctagttagacagtccagagaagattagtggtttgttcaatgttaggcttccaataagtggccaaaattttaactttggtacacagttatctttgctaagacatcatatgcattcctaaaaaaaaaaaaaaacactcttcagttagcaatatagtatacttaaaataatagggcttatgagaaaaatggggttggtgttagaattaggaagtaaaaaacctgagagtgtaatacaaatagaaatactagcatggctgaatctctgtaaacatttgccttt

SEQ ID NO: 464570 - DNA, 2116 bp, Homo sapiens
aaccacagctgacacacagatctgaggacaagaagatcgtatttatgttaccacttttctcagggtgcttaacctgcttcagtgcggccgttgctaccgcccgctgcctgggacaggaaactttagctgttgctaaggcaactgcagagttctggctcttaagctggctgtgcgaggagtatctcagagccccagatgcctctgctgtcactcactgtcagaccaagtgcaaaggacttggtagtgaactcacagaaacaatgagaccatttttgaattctgaaaagcaagttattgtgatctactcctctttggagtttttcctggctgtgtcagaccatggcttaggctatagacaaggaagagtctatgtgtcccaacttggctgctttgtaagaagtggacttctgcctcctcagcctaacctgaagaatagaaccagcttctttcgtggcaattttcccccaggagggatttccctgcagtggacctcctccccattggtaccttcagccatcagaacacctcgctttagatctgtgggtcccaaatttcatcaaatccaatgaccatttctatgtccttagtaattggtggcaacctggtggagagggaagaccacaggctgtggagttggacctgggtttgaagattggctttgcatgcctagcaggatgtaagcttggcccactgacttcacttctgagccttgttctccatgtctgtcaagtgcaggggaaggatcactcattctgggggcagccctctggcatgtaatgagcagtcctatggagaggcccatgtgacagtagccatgcgagtgacactggaagtgaaacctgcagctccagtcaagcctttagaagactgcagccctggctgacagcttgacagcaaactcatgagagactctcagcttgaacaactcagctaaactgttcctgggttcctggtcctcaaaaactgtatgagatgaaaaaaaagtttgtttttttaagctgccaagttttgggataatttgttattctaatatattttttaatacctggaaatctctaagcaataatcttttacgcaatcccctttattttgttatgaaaaaagagcctaggtagttcttttaaggtttacttttttgtaaaggttccttttgtatctcttttcactagcagaggtgtctgctatgggtaggattccctctggggttccctttgaccaagcttctgcagccagaagcactgaggagggcactggggtgatgggactgaccctgaggccctgatcacaggactcctaagtaggagttcctctgaggagatatgctaggacctggtttatcaaaccagcaatgggatatctggaaaagccgctggggggctgccaggactgcttctcaacatactgtgtgttaacctgcattaacactgcacgaagcaggaacttagagttttctgagcttggctcagtttgtgtgtaacaaccaggctgaggtttcaggggtggctccatttggggtttaacctgcagaccagaggagggaacaatgaaagactagttgtgtttctgtgtttctgtggtctggaagaggaggtgaagagagcgtaggacaaatcactgagtgttcatgtcaaaatatctgcagactgctcagcttggttgctgttgagctccctagttcagcagcagcaggtcgaggaccaacacttatcctcggataataatgactactatttattcagtcctcccatgtgctagatgacatattaggtgctttatgtgtacaaccttagcaatcctttaagagaggtgatattcccatttgtcaaattttagaaagctagttagacagtccagagaagattagtggtttgttcaatgttaggcttccaataagtggccaaaattttaactttggtacacagttatctttgctaagacatcatatgcattcctaaaaaaaaaaaaaaacactcttcagttagcaatatagtatacttaaaataatagggcttatgagaaaaatggggttggtgttagaattaggaagtaaaaaacctgagagtgtaatacaaatagaaatactagcatggctgaatctctgtaaacatttgccttt

SEQ ID NO: 464571 - DNA, 2079 bp, Homo sapiens
aggcaggagagccaggtttatagcagcagccactgctgggtactctggagccagagagtccctgggcagcatgctgtgtgccctgctcctcctgcccagcctcctgggggccaccagggccagccccacctcaggcccccaggagtgtgcaaagggctccacggtgtggtgtcaggatctgcagacagctgccaggtgcggggctgtggggtactgccaaggggccgtatggaacaaacccaccgcgaagtctctgccctgcgacgtatgccaggacatagcagccgccgctggcaatgggctgaaccctgacgccacggagtctgacatcctggctttggtgatgaagacctgtgagtggctccccagccaggagtcttcagccggatgcaagtggatggtggatgcccacagttcggccatcctgagcatgctccgtggggccccggacagtgccccggcacaggtgtgcacagcgctcagcctctgtgagccgctgcagaggcacctggccaccctgaggccactctccaaagaggacacctttgaggctgtggctccgttcatggccaatgggccccttaccttccacccccgccaggcgcctgaaggagctctgtgccaagactgtgtacggcaggtctcccgactccaggaggctgtccggtccaacttgaccttggccgacttgaacatccaggagcagtgtgagtccttggggcctggcctggccgtcctctgcaagaactacctcttccagttttttgtccctgctgaccaagcactgaggcttctccccccgcaggagctctgcaggaaggggggattcttagtggccatggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcaacccatgccctggagcgcgtgtgctcggtaatgcctgcctctatcacgaaggagtgcatcatcttggtggacacctaacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggacgcggagaaccagggcagcttctgcaatgggtgcaagaggctgctcacggtgtcctcccacaacttggagagcaagagcaccaagcgagacatcctggtggccttcaagggtggctgcagcatcctgccgctgccctatatgatccagtgcaagcacttcgtcacccagtacgagcccgtgctcattgagagtctcaaggacatgatggaccccgtggctgtgtgcaagaaggtgggggcctgccacggccccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggaaacacgcgtgaccgtggctgccagagacccagagcctgctagcgaggcccatgagaatggggatgatcatacctgcctcacaagaatgttgagacaattcacagagacgttctggagcccctttcccccgagaccggcattcatgagtctgctgggaccagaaaacccatctcaaggggcccagcggggcacccaggagagtctggcggtgcaagcgctctagcctctgaaaatgcattttcattgttatatttttacagatctttaagttacactgtgatttccaggtctggtaaggcagattcactttcccagagtaccttaaccactctctgctgctgttttcttcatgtcttcctcaccaaatgcccttagggcaggaaagaaggcgatgggacctggtaaattagccaaatgctgatgccaaggccctgagagcacgtatgggtgcagggatgcccagctgctgtgagcccccaagccacat

SEQ ID NO: 464572 - DNA, 909 bp, Homo sapiens
tcacagtggtggaatgtcatcagctaaggcagcacctggctattttcacttcttttgtggatcttcagctgcttcaggccatctggatgtatacgtgcagatatgctaattataaagaaatactctagatattttgacgatttctttggtgggggaaaagaggagtgtaaggatatagaagaaaataaactcagattctcctgctatactctcacaacacagaacatgtcttcagttcagttcaccattttgcaaccaggactatcattcacaagcctggcaaagcctgactgtgaagtctgtacctctactctcgcctactccttagatgaaatgacctggaacacagaaaaatatgaaataaagatagaccattttgattatttcatagaaagaaatgtcatggtattacttattattaatgaatatgttgaaggaataattagtaaaaatgaatatatgatatatattgcagtgctttgcattgatggcctgatgcaaatagcagtaattacttacacaggatggctaacatttctgggaaagacattctaatcaatagttgctatctgtggtaggttaagtgtttgaattaaaaaaaaaaaagcagtaattcattgtgatacttccaaatgcactgttcacattttaagttggagacagattattacaagaaataggaaagataatcctaaatcttagtcaattttttttctcattacagattttaaaaagtgactagtaagggagaattttgagagtctagaaaacctggagggaaagaaaaaagagggaaggaaggagagaaaaaaggaaggaaagaaggaagaaaggaaaaaaaggaggaagggagggaggagataaaggaaagaaaaggaaaagaaaaaaggcagaaagaaaagagaaaga

SEQ ID NO: 464573 - DNA, 1859 bp, Homo sapiens
tttccacagcatttcctcaggtgcatgaattcttactctgctcttgcaggtctgggaagggggagaatcgccctggcacagacagccggtgtcctgaggagtctggagcaggaggagccctttgacctctctcagaagcgccgggccaaggtgccggtgttccagtcagacggggagagtgcccagggcagccactgccacgaggaggaagaggaggataactgctacgaggtggagccctacagccctggcctggccccccagagccagcagctctgcacacccgaggatctgtccaccaagtcggagcacgcccccgaggtgctggaggaagcctgcaaggaggagaaggaggatgcatccaagggagaatgggagaagaggagcaagggtgaccttggggcagagggcggccaggagagagactgtgccggcagagatgagtgtctcagtctcagggcttttcagagtacccggcggggcccctctttttctgattacttatacttcaagcacagagatgagagtttgaaagaattactggagaggaaaatggaaaaacaagcagtgcttttaggtatctaagtggacagttttaaaattacatttggaaaatgagaaggaggcagttcaaatatagctttctgcatgaactgtcattttctggagactggcgaatagtaccaatctctacaaatggcttagactaaatgagcagggatgtaggtaatggaaagccttctcaggtcattcacggggcccttgatacccttcacacatgtgcagggtcttcatcagtggcgttttatgcattgccagtataataaactgcactggcactgagaaaagcaatactgactgggtgtcgtgtacgtgtgactgcccatagcaataaccctctggtactgtgtctgtttatgtaaaaacttcttgtttggtagttttgactcgtatttgtagagctaggtactggttattattgtgcttcatcctatcccagatttcccagtacattcctttagaagacatgtccatctccaactgctgggggctggccttttctgtaggccaaggtgctgccccattagccccacctggttgtcatcactcacccatgtgttgtgtccatctctgacccatttcccctgccaccttgcctaaagcttctcctgtcagcctccccaccaccatgaagtgctaagagtactatgtcctgaggtaagggcacctgcaacggagattgtgaagagaagactgtgggtttctgtggttacaagcacaactctgggtcaaaaacccattccaagtcctcagaggggcaagtcccttccattcagtattaatatagctcatcagtgcctctgatgaaattgcccaggatgctggcagtgtggcctgggaggcttccagctcttggggtctggttacacatttattcacactgcggccatgtgttgaggacctactatgtgctgtgtttgaccacacgtcctgtagaatgccgtttggttctgagtatgcctggctggaatggaaaccaggaaattctagagtaacaggctctagtcctttccaaccaaaacaaacctcatgggaatgtttgagggaccagttaatgttgagacagagagagtatggtctagaatggtggttttcagattgtgttttgagaagccagaggtcatctttaggcctctgaagagtggtaaggggaggagaagctctcaactcccacacccacctcactccaagcagctcaagttccatctgatttatacattagcattctaagtaaaattttatttggaggcagtaaaaaggtctaggagaaataaaaacaatttgttatggagtgtatt

SEQ ID NO: 464574 - DNA, 635 bp, Homo sapiens
gtgagatacaatatgcagaggccagttttggggcgagccggaggccgggcgcgtctaacctgcggggaagggaaagcggagggtaaggcaagggctgctgtaggcgccagacaacagggactctccgaaccggaagtgccccgcgtcgccatggctacaggcgctcccagcagaacccgtagcgttccgttcccatggcaacggtattgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatggtaaaacaaaaaactcactaaaattttgtttccatttaaaaatatgttcctgtttagagaagctttgccttc

SEQ ID NO: 464575 - DNA, 1296 bp, Homo sapiens
agcgggtcgccttgggcggacctgggctgcggaaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacaagtagcagttcatccagatggagaagagaagccattcctggaagaaggaactctacatacaaaggcacagaagcatgacagagggcagtgtatggaggaatggtcttctgttatcaaattgaaaacctctatacaggatagccaacaataaagacaaccttgttgatgataaa

SEQ ID NO: 464576 - DNA, 1251 bp, Homo sapiens
gtgagatacaatatgcagaggccagttttggggcgagccggaggccgggcgcgtctaacctgcggggaagggaaagcggagggtaaggcaagggctgctgtaggcgccagacaacagggactctccgaaccggaagtgccccgcgtcgccatggctacaggcgctcccagcagaacccgtagcgttccgttcccatggcaacggtattgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacaagtagcagttcatccagatggagaagagaagccattcctggaagaaggaactctacatacaaaggcacagaagcatgacagagggcagtgtatggaggaatggtcttctgttatcaaattgaaaacctctatacaggatagccaacaataaagacaaccttgttgatgataaa

SEQ ID NO: 464577 - DNA, 157 bp, Homo sapiens
cagaagcatgacagagggcagtgtatggaggaatggtaagtactttacagctgttgtacagggcagcatgtcctgaaaggggctgcaagaaatgctgattccaagggatgtgtgccagttctctgggggaggaagaaaggctctgtagcagaaagac

SEQ ID NO: 464578 - DNA, 1562 bp, Homo sapiens
gtgagatacaatatgcagaggccagttttggggcgagccggaggccgggcgcgtctaacctgcggggaagggaaagcggagggtaaggcaagggctgctgtaggcgccagacaacagggactctccgaaccggaagtgccccgcgtcgccatggctacaggcgctcccagcagaacccgtagcgttccgttcccatggcaacggtattgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacaagtagcagttcatccagatggagaagagaagccattcctggaagaaggaactctacatacaaaggcacagaagcatgacagagggcagtgtatggaggaatggtcttctgttatcaaattgaaaacctctatacaggatagccaacaataaagacaaccttgttgatgataaa

SEQ ID NO: 464579 - DNA, 4559 bp, Homo sapiens
acacctgctctccactcctgtcccagccaagcctccaaggcaccggcctgcggccctggcgagctggggagcctggggcgggtggaggggatgcgtctgcacggaggcccttgcccttggtcagccccagtcagccatggtcagccccagtcagccatggtcagccccgatcagccacggtcagccccagtcagctgtggtcagtcctggacagccccagtcagccatggtcatcctcagtcagccatggtcagccccgtgcccactcactctcctaggcagccgagggaagcccccagccccagccaaggagactggagtccttcgtcacagccgaagggacaagaacatggacgacagtggcaccagatccaagaacccagtgtccttcagagtggccctcggggggccggccgagcctaccacatgcaggatggacctcagaggcatccgggcctcctcacacttggacttcctccttgctcgccccctcacccttgtggcagggaccgtgctgcggacatcagccctagggctggcccagagtcttcacctgggccagcagcaccgagggtccctcttccacacctgcctactcccggaacaggccttcactcggaacctgggctctgggtacaagggacgcacctggttccaccctctccctgtgtcccggacagtttgctctgatgagtccaggaaccgagaacgggagaaccctccaggtcctgggcactgctttagccctgtctctccaatcatcgcccagatcatcacctgtgtctctccaatcctcgcccagaccatcacctgtgtctctccaagcatcgcccagaccatcacagcagctaccgggtacatcattgtcatcatcatcatcatcatcatcaccaacaccaccattaccatcacctccatcaccatcatcactatcaccaccgccatcaacagcatcatcaccaccaccaccatcatcgacatcaccaccatcaccaggaccatcaccaccatcatcatcatcaccaccatgaccactatcagcaccatcaccaccaccaccatcaccgccagcctcactataataaccatcatgtcttaactccttgtcaggctctgtgtgaagcactttaggagtgttcctcatttctaccctcacaacaactcttcagagtagtgctgttcatttttcctattttacaaatgagcacattgcagttcagagaggttaagtgacttgtccaaggtcacacggccaccagatgtggagcagggagagaaacacagagctgcctgacaacagatacggcgttttggataggaaggggaagatcaaatgcaacgtccagacccaaacccccgaatgtcagagagcatcctcacctttcaaaaacctaatctcccccaaacaatgctgacaataagaatctgtcaacagatggaagagatggttaggatccaaaataagcagctgggactagagagtgcctttcaagtgatcaagatgaagctgggtgaagcgccatgccaggccttgctgttgcactgtgaaagcacaagagcactcattcattcactctacgcgttgatgcattcaacaaacctttccaagtgcccccactgcacccagaaccatgaggcttcttggctgttacacagaaggaaagtaacccccatcctcgacgctatgcacacatcttttttcagtgtattcttctcaaatagatagtcccaggcaactgccatgttccaggccctgggctgatcccatgagtactgcgaggatggagacatagcgtgagggggatgggagcagctgagtgacagccatgcatacgaggcttcgggtgctgcacgactcagtcaccatcaacaaggttgcgacccatgacgatgttaatagtggtagctccatacctggaaggaggacggtggagtcccacttagacctggggctattcacacagaagccttgtaatcagtacttagggggaacaaggagaaccagagcctgctcagaagagggtggcagagtgatgtaggggcagagaacaactgtgccttgcaggggacagttgagatggaaacagatgcgggagctgggggcactgagggagaacccgctgccatcctcatacctcggtgtggctccatggggcagaaaggtacagatcttgcttctgaagccaggaggacagagccagccccttgggcaggagcccactcaaacccaacctggcagctatctcctgtgataaagaggccaaggggcttgagcctcccagggacacaccagcagaacaaattcctgagatgtagaaaagcacccaggaaagctgcagaggaacccttgtgcggggaccggctccgggagccacagcagccagggctaaagagtactttggaatgcagcccctcattttgtggcagtggccgctgagaccaagagctgggtggcatctcccccagaggccagagctgggactggagcctagggctgagggagccggagccctggctccttcaagattcaggaggcctctgaagcttagtgcaggccccgctgagctgtgagcagcaggcagcctccaagtggcatagactgcccaggcccacactcaggagctgggtggctccagcccagccgccctctgacttctgtcaccttatgaatgagatgtcacttgactcggaggccagagtgatgatgagagctgtgaggacaaggtgacctggcagtcgccacctccttgatcacccaacccagaggccaaccgaaggccccagggtgagctcctcatcccagggccccaagaagaaaggacagcagatctgagtgggagccctagggacccttccactctctgctgctgtcctggccacagtggatacggacaaaggcagcagcgtgggggctgtggatgacacgtcattcgcccatgtctggcagcttccaacagcagcacacaggccttgctgcctcctggacatccaggggaccacttgtggcatgctctggccaggaaaactgcagctgccaaacgcctggggggacgccaggctggaccgtggtgggagctttagatgctgagacaaaaccacacaatgcttcagtgtcttccctccaaacactctgcctctgtgtgggctgtgtgctccaagccaaagagccacagagccactgagccacctgcatacatacaagccccacccatctccaaagagaaaggcagcagggtgcctcccctggcatttaggtccatttccatcccagccctgtccaagcacatggcaaatagaggtcaagtgacagcgtccaaccaggttccaggacctcccaagtgcctatgcctcccagcacccctgggccgattctggaaccacttagggaatcgcccagccagaaagctgggagtctgcctggatttgccgtcttccacaccctgtatgtagtgggccacccactggttctgcctcccacctgtattccctgctccccgggctcagtcctcaccagctaccgcctgggccaaggtgcccacctcctacaggaccccgtgtttccaggctgcccctttccatgggtttccactgcagccagagggagaatggggtatggacgtgaggccaggtgagtgtgtgcctgtgttagagatgacacagtctccagaactggctcattaaactgcttctctccatgcaccccctgcccccataccaagaccacatttcccagcctcctctgagtggggcgtggccatgtgactgagctctggccagcggaatgtgggcagagtcctgggtgccatggtggaccagcccataacaccctcccccgtggaatcccgccagcctctccttgtctcctagatctggaggagggcagagccacaaggaggcaggagcctgggcccctgattgactgcaggggcgtgaaccagatgtactctcacccccacctgccctgaagttctcatcagactgagacaagaccaggaaacaccttttggtttggggacgtttgttccagcagaaaccactcagagaatgcttgcacattcatatccctttgtgtggaaaaaatctggataaatgaatacccatgatgtggatagcaatagtcttcgagctgtgagatttggggcaattaataaaaaatttctatcaacctggagccctgggttcccaccctggccctgcccctgccccaggccttctgccttgcatggatccttggcctgtctgcacctctgtttcctcatctgcaaaacgggaatgatgagagaacccacctcccagggtcatcatggtttactcctgtaaacacttagccccccactaaaaaacagcagtggctaataagccatgcctttgtctgggcttgcgttctattcaccatcttgatggagattacatatcaacctcttgtacatgtgtaactattagaagcggggaagccttattgtccttggtgagtaggaccatgtatgaattttcttttcaatattttctacatgttctagaatgtctacgtatctttataaaggagaaaaaacgaactt

SEQ ID NO: 464580 - DNA, 1059 bp, Homo sapiens
aatagcctcatcatccccaccatcatagccaccatcaccctcctacaggaccccgtgtttccaggctgcccctttccatgggtttccactgcagccagagggagaatggggtatggacgtgaggccaggtgagtgtgtgcctgtgttagagatgacacagtctccagaactggctcattaaactgcttctctccatgcaccccctgcccccataccaagaccacatttcccagcctcctctgagtggggcgtggccatgtgactgagctctggccagcggaatgtgggcagagtcctgggtgccatggtggaccagcccataacaccctcccccgtggaatcccgccagcctctccttgtctcctagatctggaggagggcagagccacaaggaggcaggagcctgggcccctgattgactgcaggggcgtgaaccagatgtactctcacccccacctgccctgaagttctcatcagactgagacaagaccaggaaacaccttttggtttggggacgtttgttccagcagaaaccactcagagaatgcttgcacattcatatccctttgtgtggaaaaaatctggataaatgaatacccatgatgtggatagcaatagtcttcgagctgtgagatttggggcaattaataaaaaatttctatcaacctggagccctgggttcccaccctggccctgcccctgccccaggccttctgccttgcatggatccttggcctgtctgcacctctgtttcctcatctgcaaaacgggaatgatgagagaacccacctcccagggtcatcatggtttactcctgtaaacacttagccccccactaaaaaacagcagtggctaataagccatgcctttgtctgggcttgcgttctattcaccatcttgatggagattacatatcaacctcttgtacatgtgtaactattagaagcggggaagccttattgtccttggtgagtaggaccatgtatgaattttcttttcaatattttctacatgttctagaatgtctacgtatctttataaaggagaaaaaacgaactt

SEQ ID NO: 464581 - DNA, 3712 bp, Homo sapiens
  misc_feature (2)..(2): n is a, c, g, or t
  misc_feature (10)..(11): n is a, c, g, or t
  misc_feature (13)..(14): n is a, c, g, or t
tngtgacatnncnncatctggcaagcactgatgtagtgcacgcttttaacacccgagttccatgccacctccccgccctttacagacatgctataaggcccccagcccagtcactccgcagtgcctctctcttcctccccatggactatacacaggccctgcttgtcctggaggaaagtttggacgtcattatatagatcaggagactgaagtactgaaaggttaaatgacttgccaaagaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaagaaggaatctgacatggcagaggacatgaagggaggggtaatgtgagaagaaggagaggcagaaaggtgagccagactggagtacccaaatcactgttcccacactaacgttagatgttatcaactttttagaaaggattactatattgagtcgtattggcttttgacttcatattaattagaatgtatttgaacaccggtgggggtaaactattcgtaatgcaattttgttgagtaatatttgaaagagattgctctctcaacaagaatgataaatcatctctgtttcaaaaataacccctgttgaagttgacaagagcaggaagggatgaagtttgccaggtaatctaataggtgcttccatatacattttctcatttatgcaccagaacaatgcttctaagtatctgttattctccatttttacaatttataaattgcccaaggtaatgtcaaatccagccctgcctcctcgggtaaactttctcctgtgtctggcagaaattcacacatttagcaccataggtaggtttcctctgttttccatttttatttttaaggttggaatttgggttctttggaactcaaatttcttgagtcattttatagatttttgctgcctagctggccagttaaaatagagaactaagaaatgtttcttctttcttcatagaaacagtttcgcttgcctcaattatatgcagagttatattgtccttcacgttgctcaggtagacccagtgtaagttacagctagaaagttagaaaaacagcagcactattttccctcacctttattagtatattatgccagagttaactcttatcatttttaatttcaagtacatatttttgaagtaaatcaattgtatatattaactattcaactgtctcttggtcagtccattataataaccctattttaatttttctttcctttttaatgcacccaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaagtcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcctacaaagtgttgtagctgagataccttcctgttttttttcttaaacactcattctatatttcccatatttcctctgataatgaatctcatctttcaataactttgtcttcacttg

SEQ ID NO: 464582 - DNA, 4031 bp, Homo sapiens
tgaactaaaataaaattctctaggtcagtctgaaaaagaagatgtgaatggaagcaaatggactgttacaaccttttccactacgccccacatgccaacttacttagtcgcatttgttatatgtgactatgaccacgtcaacagaacagaaaggggcaaggagatacgcatctgggcccggaaagatgcaattgcaaatggaagtgcagactttgctttgaacatcacaggtcccatcttctcttttctggaggatttgtttaatatcagttactctcttccaaaaacagatataattgccttgcctagttttgacaaccatgcaatggaaaactggggactaatgatatttgatgaatcaggattgttgttggaaccaaaagatcaactgacagaaaaaaagactctgatctcctatgttgtctcccacgagattggacaccagtggtttggaaacttggttaccatgaattggtggaacaatatctggctcaacgagggttttgcatcttattttgagtttgaagtaattaactactttaatcctaaactcccaagaaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaagaaggaatctgacatggcagaggacatgaagggaggggtaatgtgagaagaaggagaggcagaaaggtgagccagactggagtacccaaatcactgttcccacactaacgttagatgttatcaactttttagaaaggattactatattgagtcgtattggcttttgacttcatattaattagaatgtatttgaacaccggtgggggtaaactattcgtaatgcaattttgttgagtaatatttgaaagagattgctctctcaacaagaatgataaatcatctctgtttcaaaaataacccctgttgaagttgacaagagcaggaagggatgaagtttgccaggtaatctaataggtgcttccatatacattttctcatttatgcaccagaacaatgcttctaagtatctgttattctccatttttacaatttataaattgcccaaggtaatgtcaaatccagccctgcctcctcgggtaaactttctcctgtgtctggcagaaattcacacatttagcaccataggtaggtttcctctgttttccatttttatttttaaggttggaatttgggttctttggaactcaaatttcttgagtcattttatagatttttgctgcctagctggccagttaaaatagagaactaagaaatgtttcttctttcttcatagaaacagtttcgcttgcctcaattatatgcagagttatattgtccttcacgttgctcaggtagacccagtgtaagttacagctagaaagttagaaaaacagcagcactattttccctcacctttattagtatattatgccagagttaactcttatcatttttaatttcaagtacatatttttgaagtaaatcaattgtatatattaactattcaactgtctcttggtcagtccattataataaccctattttaatttttctttcctttttaatgcacccaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaagtcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcctacaaagtgttgtagctgagataccttcctgttttttttcttaaacactcattctatatttcccatatttcctctgataatgaatctcatctttcaataactttgtcttcacttg

SEQ ID NO: 464583 - DNA, 1370 bp, Homo sapiens
  misc_feature (3)..(7): n is a, c, g, or t
  misc_feature (17)..(18): n is a, c, g, or t
ctnnnnncactaccaannatttacattgtgctaaacaacttatgcacattatttctttgattctttttaacacatggttgtgggctgaatggtgtctcccaagaagtcatatgccgggatcctgtcccatagtgcctcacaacgtgacattgtttggagttagggttgttgaagatgtcattagtcaagatgaggtcatacttgagtgaggaagaagagaactgtagacatgcagcagccatcttgtggatatgagggaagagccaaatagactacaaatcggttaaaacagagaactaaaattgtggagctactgaatgaaccagctatggaattgtctgtgtgtgggcattcagatggacataccggataaaattctggactggcaacagaagcatcttctgttctaatgaagtgactcttggtgtgtacccggataacctcatgactggagttggttggctgctagaagaacaaatcatgtgattagagtgttggaactttcaaccttagccctcaacttctggggaggggagaagcgcaaaaggtagagttgaccactaatggccagtgatttaactaatcatgcctatgtaatgaagcatccataaaaaactaaagatcacggtgcagagagcttctagattgctgaataagtggtagttcctggaggatgatgcacccagagaggcatggaagctctgtacctctttccacatgtctttgcctatgcatttcttccatctggcggatcatctgtttgctttgtagtattttgtatttaaaaaatggataaatgtaaataaaatgtttccctgagttatgtgagccactatagcaaattaattgaaccaaggagatcatggaaaccccaatttatagctgcgcccacgcaagggtgctgtccaaaccagagacagcctatggggactgccagttagctctgccaaaaaacatccttcctgtccaagtctcccccaagtctctaataagaagagccaccttgaagctttggactccaagcatggctttccggtacaactttaacacagaagtttatattcaattacctacagataccaaaattatcattactatcattattaataaacatacagttaattacaacaagtcttcaagaatgaatatgagttattctggagaagaaagtatgtgtgtttggcaggaagtacaaatgcttggagaagacaaattaaatagcacatccaaactatggggatgtgaaagaatgtggagtgttggtagacttatgaaagggtagcgtgggccaggacataacctaaatgtgggagaatggagagaaaggatgctgttcaaattatggatggctttgtgtacgacattgaatt

SEQ ID NO: 464584 - DNA, 487 bp, Homo sapiens
cctcagagccttcagaagaaagcaatcctgctggcaccttcatcttggactttgagcctctagaactgtgaggcaatacatttctgttgtttaagccacccagtttgtggcattttgttacagcagcactggaatcctaatggatgctgtattagataaatattttaggcttaggaagaagagaactgtagacatgcagcagccatcttgtggatatgagggaagagccaaatagactacaaatcggttaaaacagagaactaaaattgtggagctactgaatgaaccagctatggaattgtctgtgtgtgggcattcagatggacataccggataaaattctggactggtaagagtgtggggaaattgccagtcttaagcagtgctgatggaggtgtgaattggtaaaacaatttgaaaagtaagttgctagtttttataaaatttttaaaaataaatgtattctctgacccagtaaaaaaaaaac

SEQ ID NO: 464585 - DNA, 523 bp, Homo sapiens
  misc_feature (3)..(7): n is a, c, g, or t
  misc_feature (17)..(18): n is a, c, g, or t
ctnnnnncactaccaannatttacattgtgctaaacaacttatgcacattatttctttgattctttttaacacatggttgtgggctgaatggtgtctcccaagaagtcatatgccgggatcctgtcccatagtgcctcacaacgtgacattgtttggagttagggttgttgaagatgtcattagtcaagatgaggtcatacttgagtgaggaagaagagaactgtagacatgcagcagccatcttgtggatatgagggaagagccaaatagactacaaatcggttaaaacagagaactaaaattgtggagctactgaatgaaccagctatggaattgtctgtgtgtgggcattcagatggacataccggataaaattctggactggtaagagtgtggggaaattgccagtcttaagcagtgctgatggaggtgtgaattggtaaaacaatttgaaaagtaagttgctagtttttataaaatttttaaaaataaatgtattctctgacccagtaaaaaaaaaac

SEQ ID NO: 464586 - DNA, 243 bp, Homo sapiens
  misc_feature (3)..(7): n is a, c, g, or t
  misc_feature (17)..(18): n is a, c, g, or t
ctnnnnncactaccaannatttacattgtgctaaacaacttatgcacattatttctttgattctttttaacacatggttgtgggctgaatggtgtctcccaagaagtcatatgccgggatcctgtcccatagtgcctcacaacgtgacattgtttggagttagggttgttgaagatgtcattagtcaagatgaggtcatacttgagtgaggtgggtttctaatccaatgtgactggtgtctgt

SEQ ID NO: 464587 - DNA, 2353 bp, Homo sapiens
gatgagaagaagaaaccgaaagactaggagatatggagttttggacactaacatagaaaatatggaattgacacctttagaacaggatgatgaggatgatgacaacacgttgtttgatgccaatcatcctcgaagtgttgaattcctggggttctttgtggcccaggccattgtccaaaatcaaaagaactttaaaagtcagtcccctactagcaatgtacttctggacttcagggacaaagcatcagtggaaccagtccagaaaaagagttttcagtgtccaggccttcttcttgtacaactaaaagactggcagctggtgtttgtcttttcccttcaaggtttggtggttagcagctttaatccagatacgaacaaagatcatcgagattcaggagaagggcaaaacccaatccaagaaatctatggaatccagtaaaatgacacaagacccgaaagtgaaaatatctcagtaggcctttgagactaaagttaagggatgatttcaagtgctcggaaagtacagcaaataaggaaatatccagagcattgacagtagtggagtgatttgcttgtacctgatttatttggaggctggagctacaacctgtgctcatcagtgtgactgagagtccccagtctgcatattctccgtacttggctacttgatgctgatcctctggtgaggtctactgctgacccagacaatgcaagctctggtctttaccctttgcccatcagccctttccctcctcctctgacaccaactttcatcttccctgcagccagagttttccaggcatgaaaaagtgactctcttctcagatatgacaggcagaaaagctgccacttacactgagtgcactttgggtctttagaggaaagtaaggggaattcaaatgaggggaacccttcatgtagcttcgcagttaactaactttgatgactgtttatctttcatcttcacagctgtttttttgaagcaaatatatttaaggaaaatagtaaactagatcctaaagtttaaaatacctttccttgttgtatcctctgctttctttttccttgtctattaagtttaagacaaatttacaatgaaaataaagtggacctctgatggtaccctgaagtctgaattttttattattattatcttttctttttcattaggtctgactcctgtgtaactatgcctgcagggaaggagatactacccaagcaggcactgttattatttggagctataatatatcccttttacaggttgttttgcatttctttcctggagataatagcagtataattttgaaatattctttagtagaagcttctactattatacatcatagaaaaaatttgacttgcactggtcactgtaatatatttgtcgttacatatattcagcaactgtttatagcaagtttggcttagttgactgatacatttccttaattatttagataagaataatcataagcattaaatatggaaggaaagttggtttgaggctacccagaggactgtgagattttgttgcatttcggtctgacatgtccttacatgcttcagtatagaagaaagtgtaatagaaaaagtcacttgatttttacttccaggtctcccactattatttccacaggcaagagatttcatgtcttcatacttcagatgcttatttataaagttaatgaagagcttggctatttccaaagcctttctcagaaatatatatttcctcaagcataggaaacatttaagatttaaattgtaacaagtccttgctcaggaatatgaatggatgtgatgaggttcatgacacagtacctcaaaatgtggcaccatggaatactgagtattttaacctaaaggaattttagaaaacaacagaagcaggaaggacactctgacattccttcacaattctcctctgaagcaggccataaaagaattatctgacattcctttaaagtcatagaaccttcatttcagatgggtctctctgtactcagaagaaaggagtgaagacacagagacagtagaatctgaacaaacaggccaaacttagttctccagcttattgccattagaccatacccttttgttctccaatcactcttcttcatgatcgtccataaaaatacacagtttttcccgtttctatgggtcttcatttctgaagggtcccatgtcttgaccataaacttgtaatggatgaagaaaagatattactctttttcccctacaattaagtgcaaaatacaggttaaataacttgagtcatgattttatatagctctaaaaattagaattctatgtggaaaaataaaatgaatctgatataaatgtatggctc

SEQ ID NO: 464588 - DNA, 1734 bp, Homo sapiens
ttttttcttctctttttcagtctgcatattctccgtacttggctacttgatgctgatcctctggtgaggtctactgctgacccagacaatgcaagctctggtctttaccctttgcccatcagccctttccctcctcctctgacaccaactttcatcttccctgcagccagagttttccaggcatgaaaaagtgactctcttctcagatatgacaggcagaaaagctgccacttacactgagtgcactttgggtctttagaggaaagtaaggggaattcaaatgaggggaacccttcatgtagcttcgcagttaactaactttgatgactgtttatctttcatcttcacagctgtttttttgaagcaaatatatttaaggaaaatagtaaactagatcctaaagtttaaaatacctttccttgttgtatcctctgctttctttttccttgtctattaagtttaagacaaatttacaatgaaaataaagtggacctctgatggtaccctgaagtctgaattttttattattattatcttttctttttcattaggtctgactcctgtgtaactatgcctgcagggaaggagatactacccaagcaggcactgttattatttggagctataatatatcccttttacaggttgttttgcatttctttcctggagataatagcagtataattttgaaatattctttagtagaagcttctactattatacatcatagaaaaaatttgacttgcactggtcactgtaatatatttgtcgttacatatattcagcaactgtttatagcaagtttggcttagttgactgatacatttccttaattatttagataagaataatcataagcattaaatatggaaggaaagttggtttgaggctacccagaggactgtgagattttgttgcatttcggtctgacatgtccttacatgcttcagtatagaagaaagtgtaatagaaaaagtcacttgatttttacttccaggtctcccactattatttccacaggcaagagatttcatgtcttcatacttcagatgcttatttataaagttaatgaagagcttggctatttccaaagcctttctcagaaatatatatttcctcaagcataggaaacatttaagatttaaattgtaacaagtccttgctcaggaatatgaatggatgtgatgaggttcatgacacagtacctcaaaatgtggcaccatggaatactgagtattttaacctaaaggaattttagaaaacaacagaagcaggaaggacactctgacattccttcacaattctcctctgaagcaggccataaaagaattatctgacattcctttaaagtcatagaaccttcatttcagatgggtctctctgtactcagaagaaaggagtgaagacacagagacagtagaatctgaacaaacaggccaaacttagttctccagcttattgccattagaccatacccttttgttctccaatcactcttcttcatgatcgtccataaaaatacacagtttttcccgtttctatgggtcttcatttctgaagggtcccatgtcttgaccataaacttgtaatggatgaagaaaagatattactctttttcccctacaattaagtgcaaaatacaggttaaataacttgagtcatgattttatatagctctaaaaattagaattctatgtggaaaaataaaatgaatctgatataaatgtatggctc

SEQ ID NO: 464589 - DNA, 2546 bp, Homo sapiens
gctactgctcactctttgggtccacgctgcttttatgagctgtaacactcaccgcgaaggtctgcagcttcactcctgaagccagtgagaccacgagcccaccggaaggaacgaacaactccagacgcgccaccttaagagctgtaaccctcaccgcgaaggtccacggcttcattcctgagccagcgagaccacgaacccaccagaaggaagaaactccaaacacatccgaacatcagaaggagaaaactccagatgcgccaccttaagagctgtaacactcaccgcgagggtccgcagcttcattcttgaagtcagtgagaccaagaacccaccaattctggacacgctacctcgatccagatgaaggtaccccaagcagcttgagatgtgatgatggagaccagtttgagaagacccatcatctctgatttccctctgattatgaagtaatacaacaaagctacagtaagtggactgatacggtggtgattgcaaactgtttctaacttctctcatttactggctggtgtctttagaggacatccctgaaggacagcagtgaagggaaatcttcccagtgggcagaactctgagcagcgcacctggttgtgcactttgcctggaaggagaaatggtcagatgtgcgattaggtactgattcatgggctgcagccagtggtttggctggatggtcagggacttggaagaagcatgactggaaaactggcaacaaaaaaatttggggaagaagtatgtggatgctcctctctgagtggtcaaaaactgaagctatttgtatcccatgtgagtgctcaccaacgggtgacctcaggagaggaggagtttaataatcaagtggataggatgacccgttctgtggacaccactcagcctctttccccaaccatcctgtcatcgcccaatgggcccatgaacaaagtggccatggtgacagggatggacaaagccacatatgctctgaatcagtatccaatatatggtactatttctccaatagccaggattcacgggtacaggaatcaaggggaggaagtggaagtggtaccactcaccatcacctctagtgatccacgagcaaaagttttgcttcctgttcccatgacattatgttctgctggcctagaggtcttagttccagagggaggaatgctgccaccaggagacacaacaatgattcaattaaactggaagtaaagattgccacctggacactttgggatcctcttaccattaagtcaacaggctaatgaaggagttacagtgtgggctggggcgattgactcaaactatcaagatgaaatcagtctactattccacaatggaggtaaggaagagtgcacatggaatacaggagatccattagggcatctattagtattaccatgccctgtgattaaggtcaatgggaaactgcaacagcccaatccaggcaggactacaaatgacccagacccttcaggaatgaaggtttggttcactctaccaggaaaaaagaatgacctgctgaggtgcttgctgatggcaaaggaatacagaatgagtagtagaagaaggtagccatcaataccagctatgaccacgtgaccagctgcagaaatgaggactgtaattgtcatgattatttcttccttcttttgttaaaaacatgtttgtgcatgtatatacttgtactaagaaaatatcttaattttgtttccctttatcttatgaaataagatttattgacttcacatctgcctttaagtacttaataactttatgtaatagtatttgatttggggattgtgtcacattttccatgtttttaaattgtttagtgtctgaatgccctcaagatctactcgtctattcacttcatgttgtataaaacatcatactttgtaaaactgctaattgacaaattctccatatatttgctaaatcaatgaataaaatgtatagctcagcattctatacatgtaaataagacattaatttatattctatcattgctaaaatctggctcagtcaaatgtttagtggtgaaaaaggagcattagtttataagtcaataggctgggactctaaccaattccgctacttgccagaaatacatcttgataaaggaaagttttctctatttcattattttcacttgcgatgtgaagaccttggaaacaatgacctctaggacctcttccaggtcctagacttataagtctgttgattttagtacaaattgttagccttttcccatttcctccagtgcatatatagagtgctttcaagaggatgtagaatttctaggccagttattctacagagtcgaagtattcttcattttaaagacaaattacccagtattggcttattttttttttttagtgtttagcatgtgaactcatagaatagtaagttgcctcaaattcagtattaccatcccaacaaaagaaatggaaaaagtagtccctaactcttggattatgtgatcttataactcattaaaattcttgtcattttataaacaagtggggaaaattttt

SEQ ID NO: 464590 - DNA, 4085 bp, Homo sapiens
gcgggtgaagctcggcgttactatcaagcaaccaaactgcaaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaagcgcccaatgtggtgctggtcgtgagcgactccttcattcctgatgattaaaattacatagtctggatgtgcccatgggattttttgaaaatattacttaaagttatctttgtgatttaaacttagagaatgggcagtactggaaattgactagatggcattttattacagagtgctcttgtaatcaaaggcaaatgaaggaagcaggattgtgcagaggagaagctgaattttgttgccatcttatgaatgacagttctcaaactagtatggtgcttcagagctgctttccaataggagtgaggagaacagacctttccacctgcatgttggatggccactggttgtgggctgctcctagaatggggcatggtgttgggcaaagcagctgtcttcagcagaggcaattgttcattcctaaaagggaatccgaatgtggatcacaacatcccagaaacttccaaagatgactgagatatataggtttgttattttttttagtgtagtatgaatgcatagatttttctatatttgtgcttaaattttttgcattcacggccgggcgcggtggctcacgcctgtaatcccagcactttgggaggccgaggtgggcggatcacgaggtcaagagatcaagaccatcctggctaacacagtgaaaccccgtctctactaaaaatacaaaaaaattagccgggcgtggtttcgggcgcctgtagtcccagctactcgggaggctgaagcaggagaatggcgtgaacctgggaggcggagcttgcagtgacctgatatcgcaccactgcactccagcctgggcgacggagcgagagtccgagtatggaattttggtatgtgcgaagtagagggtgcttatataatcagcacccccgcctaaaaaacttgggtactgattctctaatgagcagaaacaacacttcacatgtgtcgtcgcaatttgatggtggaagaattatgtcctctgagactccaaccggacactttaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaataaaaataaaataataataattaccaatttttcattattttgtaagaatgtagtgtattttaagataaaatgccaatgattataaaatcacatattttcaaaaatggttattatttaggcctttgtacaatttctaacaatttagtggaagtatcaaaagaattgaagcaaatactgtaacagttatgttcctttaaataatagagaatataaaatattgtaataatatgtatcataaaatagttgtatgtgagcatttgatggtgctcgatgagttacttgtatttgatgggattgtttggatgtatttaatgggagtatttggagtatttaacgggatgtaaaccctggatgtacctgattttgttactgttttattttaataggtaatatatatacagggtaaaagcttcaaatggtacaaaagggttaacagtgatcgtgaagtctctgtcctttccctcttccctgccatccagttccccctccaagaagcaagtaccgaaaccacctgcttacgcatttttagagattggccacaaatttataaacaaatgtatatattcctttccccctacacaaacggtaacatactgcacacattgttctgcatgttgcttctttttccttttttttttcacttaacagtagatatctagaggtgaaattactgagtcaagactatatttagcaaaattacactagatactacaaattacctctaaagaaggtatactaactgataatctcaccattatttttctttttatgagtaacgtagagcatattttcatgtatttaacagccactggaatctgctttaccatggcctttcctatttctattctttgcctatttttctgttggttgttggtctttgttttgtattacaggtgtgctttagatattagctttttgtaagagatcctgcaaatatcttctttccagtttgtcattgtcatttgtcttttgactttgttctggtattttttgatatgtagaaatttttattttcatgtaagcaaatttatgaatctttgtacaccataagtatatacaattatgatttgtcaattaaaaatattagtacaaaatttacagatctttgcttttcatttattattttttgtccttttgataataaccattctaactgggtgagattacacctcattgtgattttatctttttctattaaaaaaaggctagatactaaatattttaggctttgtgagccatatggtctctttcacaactactcatctctacc

SEQ ID NO: 464591 - DNA, 4139 bp, Homo sapiens
gcgggtgaagctcggcgttactatcaagcaaccaaactgcaaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaagcgcccaatgtggtgctggtcgtgagcgactccttcattcctgatgattaaaattacatagtctggatgtgcccatgggattttttgaaaatattacttaaagttatctttgtgatttaaacttagagaatgggcagtactggaaattgactagatggcattttattacagagtgctcttgtaatcaaaggcaaatgaaggaagcaggattgtgcagaggagaagctgaattttgttgccatcttatgaatgacagttctcaaactagtatggtgcttcagagctgctttccaataggagtgaggagaacagacctttccacctgcatgttggatggccactggttgtgggctgctcctagaatggggcatggtgttgggcaaagcagctgtcttcagcagaggcaattgttcattcctaaaagggaatccgaatgtggatcacaacatcccagaaacttccaaagatgactgagatatataggtttgttattttttttagtgtagtatgaatgcatagatttttctatatttgtgcttaaattttttgcattcacggccgggcgcggtggctcacgcctgtaatcccagcactttgggaggccgaggtgggcggatcacgaggtcaagagatcaagaccatcctggctaacacagtgaaaccccgtctctactaaaaatacaaaaaaattagccgggcgtggtttcgggcgcctgtagtcccagctactcgggaggctgaagcaggagaatggcgtgaacctgggaggcggagcttgcagtgacctgatatcgcaccactgcactccagcctgggcgacggagcgagagtccgagtatggaattttggtatgtgcgaagtagagggtgcttatataatcagcacccccgcctaaaaaacttgggtactgattctctaatgagcagaaacaacacttcacatgtgtcgtcgcaatttgatggtggaagaattatgtcctctgagactccaaccggacactttaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaataaaaataaaataataataattaccaatttttcattattttgtaagaatgtagtgtattttaagataaaatgccaatgattataaaatcacatattttcaaaaatggttattatttaggcctttgtacaatttctaacaatttagtggaagtatcaaaagaattgaagcaaatactgtaacagttatgttcctttaaataatagagaatataaaatattgtaataatatgtatcataaaatagttgtatgtgagcatttgatggtgctcgatgagttacttgtatttgatgggattgtttggatgtatttaatgggagtatttggagtatttaacgggatgtaaaccctggatgtacctgattttgttactgttttattttaataggtaatatatatacagggtaaaagcttcaaatggtacaaaagggttaacagtgatcgtgaagtctctgtcctttccctcttccctgccatccagttccccctccaagaagcaagtaccgaaaccacctgcttacgcatttttagagattggccacaaatttataaacaaatgtatatattcctttccccctacacaaacggtaacatactgcacacattgttctgcatgttgcttctttttccttttttttttcacttaacagtagatatctagaggtgaaattactgagtcaagactatatttagcaaaattacactagatactacaaattacctctaaagaaggtatactaactgataatctcaccatcaatgcatgtcttcttatcctttgccaacctaacagataaaaatgttctatttttatttttctttttatgagtaacgtagagcatattttcatgtatttaacagccactggaatctgctttaccatggcctttcctatttctattctttgcctatttttctgttggttgttggtctttgttttgtattacaggtgtgctttagatattagctttttgtaagagatcctgcaaatatcttctttccagtttgtcattgtcatttgtcttttgactttgttctggtattttttgatatgtagaaatttttattttcatgtaagcaaatttatgaatctttgtacaccataagtatatacaattatgatttgtcaattaaaaatattagtacaaaatttacagatctttgcttttcatttattattttttgtccttttgataataaccattctaactgggtgagattacacctcattgtgattttatctttttctattaaaaaaaggctagatactaaatattttaggctttgtgagccatatggtctctttcacaactactcatctctacc

SEQ ID NO: 464592 - DNA, 2056 bp, Homo sapiens
tagattaaatgcgtttaatgtgatggggagaaggcgcgggaaggaaggaaggaggcgaagcggtgcgggagggaggcggccgttgccatggaaggagctgcaagcctccctgcagaccgcgagccggagcccccgcacccccggggctggccccctggcctcccgccccagcccgggccggcggcccctccctgctccgctgtccgccttgggtacagaagcggcgagtggcccctttccaggaggcctgtttaccagcacgacaacggcaaattagtgcgcttaagaggcattcggcgtttaccccggccaacatgcgcagcgtgaagggggcctgcgaggcctgctccccggaatctgctgaaatggcccccctcgtgcatcttaatcgacttacttccacccatcacattaaacgcatttaatctactcttgcaaatggctaattttgaaaatccgcttatcagaattagccgtgtctggggctgcaggcacagtggttccaacagagcagcgggagtggacagcggtcacagagggaagggaaaacagtcccagagagagggtggactctgttctcagactgaggaggccgggaagggaaaggcgggggcggggcgagggtctgcagcaacagagccggcaggaataccaggtcatcacggtattgtttgttgattttgaaagctgagttgcatttgagagatgaggttatgtgccagcggaaagaagcagctcccatctgcataacccagccacccacctcccaaggcagaagtgaaagcaccaggctccccctgctgcaccccagatgcagccagggtggaggtgtccagcctgagctctcccatctgatgcctgctcctgggacgcggactctggagtgggcatctcagggcccacagggacagcaggacggcctgccccacctctccccaccgtggccacaacaacgcccagacagggatgttctggtttcctctcactccctgcccatctccaggcctggtttctcagcttcctcctgatttagggaggccccaacaagcacccaagagtgtccttttcttccatttgcctcacagaatcctcttgacattcacaaaactcaggtttctgtccagccagggccagctcactcccagggcaccagccctgtcctctccaggcctgtctaagaggaggctacacccagccccagaggtgagagcatttcaccaccccttgcccgggcactcctggccctcacgggacccccgtggaggtgtccgctctcagacactgtgacgccctcacggccaaggtcagagagcctctttcaaggaccttcccctctctggaccttgccgacagtcctagtttctagtgataggctcgttcccgactcattggtgggaccctggcaaggtgctcggtgaacgagctcactcacgttgacgtttcaatcagcatgtttatctcccacccacccacccctgcactaaccgaattttttctcctgccccgagggtgtctttcctcttccagcctccacaccatgcatgactcacttgctgcggagtcgggcattcaggctgcagaggctcagcgtcaaggctccaaagcctctggaaggagatgccaatggatgtgggggggctcatgagcaccaccaggtggtcatctggaagctgagtctctctgagggcctctgtagtcaccaatggtcacaaacggccagcggtcactcatttcccatcagcgttctggataggagtgatgctgtccaagcccctggaatcaccagaagcttcctgtgcgtgctttatctcaccactggcagcccagggccccgcagagaactgccactcagtaggtcttcgttggtatttgctgaagaaacaagtctgcccctaaacagagaaggtggcaaggtagttactatctggcttggagattatgtatgagttgattggtcacgtcaaaagtcaaaattaaatctatccagatgccatagttaaaagggcccaatgatgtattggttgggtgatttcttttgtgaaaacagctctaaagc

SEQ ID NO: 464593 - DNA, 1227 bp, Homo sapiens
  misc_feature (1212)..(1214): n is a, c, g, or t
  misc_feature (1216)..(1217): n is a, c, g, or t
  misc_feature (1219)..(1219): n is a, c, g, or t
  misc_feature (1223)..(1223): n is a, c, g, or t
  misc_feature (1225)..(1225): n is a, c, g, or t
  misc_feature (1227)..(1227): n is a, c, g, or t
ctaagggatgcgtggggctggatgctgctgtttattattagatgcatattttgctactcctggtcttgggcattaggggccattatggacatgtttcagtgctgcagagattttgtttatggccagttttggggccagtttatggccagattttggggggccctgctcccaacatgtcccgcttctctgatttgcaaatcaacaaaagcaaaggcagctttgtcatggttttcttccgccatctatgacagcttcttgatctgtccccaggtgggtggctgtgttcaacgggtgttgctcgtgacaggttccagtcctcgagggttaactcctcctgtaaaagatgaagaatgtaccatttggcaagttgggcatcactggacaatagctttagcttctttccagaatgttgattgtcctgagttccagagcctcaaagagcacccagcataactgtgggagaatagtaagcattggacacaaaatggtttaggcaaataatgatgaacaaaaatggtcagtctgtgttcctgctgacccagcacagtggggacgctgtgtaggacatgacctttgggggaaaggacacaagaactcagcgtgggggatccagaaaagaagtcgcacgtattgaagccagtaacgccaagccagtgaattctccttgacgagaaagacccacttactctgcagaagagatatatgacagctgacaatccctggaggagaatctttctactaaattggtaagggatgctaagcaaatgatgtggactcaggaaacaacgcatttcatgatatacggttgcctctcaaggtgaattcgagacccctcttgaattacaaagagttgaaaacattcaagtacggaataaactattactgcgaatacgctcatatgacacaagaacaatctctgagcttctttgaggatgtccagatgactgctgactgcactaattgcatcaatcgtgtatccatacaggttctttctataaaatagtggtcgctagttatgaggcgttaagccttcatggatataaacagactattccacctaagtgatctggcagaagcttagttttctaccacaacatccaccgtcctccctccctcccttcctagctggtcagaaaagctactcagaataaagactacatttcccagccatctttgcagctaggtttatccacctgactaaattccaccggnnngnnanaagnanan

SEQ ID NO: 464594 - DNA, 887 bp, Homo sapiens
ctaagggatgcgtggggctggatgctgctgtttattattagatgcatattttgctactcctggtcttgggcattaggggccattatggacatgtttcagtgctgcagagattttgtttatggccagttttggggccagtttatggccagattttggggggccctgctcccaacatgtcccgcttctctgatttgcaaatcaacaaaagcaaaggcagctttgtcatggttttcttccgccatctatgacagcttcttgatctgtccccaggtgggtggctgtgttcaacgggtgttgctcgtgacaggttccagtcctcgagggttaactcctcctgtaaaagatgaagaatgtaccatttggcaagttgggcatcactggacaatagctttagcttctttccagaatgttgattgtcctgagttccagagcctcaaagagcacccagcataactgtgggagaatagtaagcattggacacaaaatggtttaggcaaataatgatgaacaaaaatggtcagtctgtgttcctgctgacccagcacagtggggacgctgtgtaggacatgacctttgggggaaaggacacaagaactcagcgtgggggatccagaaaagaagtcgcacgtattgaagccagtaacgccaagccagtgaattctccttgacgagaaagacccacttactctgcagaagagatatatgacagctgacaatccctggaggagaatctttctactaaattggtaagggatgctaagcaaatgatgtggactcaggaaacaacgcatttcatgatatacggttgcctctcaaggtgaattcgagacccctcttgaattacaaagaggtaagctgtctccaaaaggggagaaaatgaaagaatg

SEQ ID NO: 464595 - DNA, 953 bp, Homo sapiens
gagaaccggaggctggagagcaaaatccggtagcacttggagaagaagggaccccagattgacaatgcccgtcttgccgctgatgactttagagtcaagtatgagacagagctggccatgcgccagtctgtggagaacgacatccacgggctccgcaatgtcattgatgacactgtcactcggctgcagctggagacagagatcgaggctgtcaaggaggagctgctcttcatgaagaagaaccacaaagaggaagcaaaaagcctacaagcccagattgccagctctgggttgatggtggaggtagatgcccccaaatctcaggacctcgccaaggtcatggcagacatccgggcccaatatgacgagctggctcagaagaacggagaggagctggacaagcattggcctcagcagattgaagagagcaccacagtggtcaccactcagtccgccgaggttggagctgctgagacgacgctcacggagctgagacgtacagtgcagttcttggagatgacctggactccatgagaaatctgaaggccagcttggagaacagcctgagggaggtggaggccccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggat

SEQ ID NO: 464596 - DNA, 575 bp, Homo sapiens
  misc_feature (563)..(563): n is a, c, g, or t
  misc_feature (565)..(567): n is a, c, g, or t
  misc_feature (569)..(569): n is a, c, g, or t
  misc_feature (571)..(571): n is a, c, g, or t
ggcgctttaaggtttcagactagtatggggtctactgttacaagaggagttgggataatagcagtagagaaagacggagtggtgaccaaggcgcaggtcacgaagttacctcttcatggagggaatctgtctttttctgatgagaaaggggacccagccatgcagaggagtgactggatcaggaaactgaagctggctcatggtcagcagccagcaagctacaaagggcttccaacagcccatgaagcactgagtcctgccaaaagccacgtgcatgagcttagaagagcttcatcctccaggctaggaaagagacagtcggtgtgcagcaagagaaaagagaggaggaaacatgtggaaagacccaaagagcaagcaaagagtgatgatgaagtgaagaagtcgaatagcaaccatttcaacagatttggctgtaaaagtgaaactggggatgaggtggaatggagagagagtggtagagacagcttgtgaccagtttactcccctgcaatggtatagatttgtggctgcaaagcagctgcttgtaaagatgagctgtaagntnnntncnttct

SEQ ID NO: 464597 - DNA, 1730 bp, Homo sapiens
gaagtgggtgtctgcctgcagtgaggctagcctgggctgctattttctgcagggcctgggcttcactctgctgctcctagcttgccttgttcttagtcaacagtgaaccacaggccagctgcagcttcctcatattgtgatgtaactcaggcaagggctggacacagagcttttaccacgccttctgtcactgagagcaaaacagagctgtgggggtctcggcttcccccactgcacagcagctcccgagctgcagggagagcgggagtgcacgggcaccaaactgcgcctcttgggggtgctgcagcggattttctaacagatattttcctctcctttattctaggatctggaagaactgtgcctcacctccgtctctctgcctctgactgctccctctactccccaggccttgctgtcagcacctgcaacagagctgtccctgctgtggtctggggaaagttccagccaggccctctgtggcgcatctatccctggggtggggcatccagggtattgaatctacaaaatgcatccatttcacctccaagtcagctctgtgcacaccaagccgtgtgcaggataggctaccctagagagcctgggtacccacgcagccttccacgaagccccacctacatggctgctgcaggttctcaccatcctgtgctcaccgggaaggctggcaggtccacaccggaaaccatgggctggggagaagcagggccttggtgctagagagacctgcccaagcattcttctgcaagccccgagacagaggagtgagcaagcctcaggggcgtgacaggtgctcaggagagagcaggacacatgcagaacctggagagagccagagagggaccggccacagagaagcccatcgcctgccagcactgacgtggacgttgggaaaaggtttctgctggtggcccagccctggctgggattcctcactcccacgcctcaagcctgagaatccttccggaaacacaaggctggacctgcacctgccaggtgaccatggcctcggtgtgggagcaacatggggagacctgggtccctgagtggccatgaccatcgacctggagcaatcagctcaggactgttagatcccctgtgggatggtgtattggtctgttctcacactgccaataaagacatacctgagactggagctcagtcactatcacgagaacagcatgaaggtaaccgcccccatgattcaattacctcccactgggtccctcccacgagacacagggattatgggaactacaattgaagactccacggacaccctgcgggaccagaggaggagcagtgggggctccccaagcctgccgctcccgggacagggctcctgccacagcagacatggaagcagggatggtccagggatcttggtcaccagagccccctgcccatgcgagtgggaaattgcgggagacgtgggctgggccagtccctgcacgctccggacacactgccaaggtgctggacctcaggtgggcagcaaggagcctttggaagagaatattgtaccctgaatcaaaacagagagtcaaattatcttaatggttgttatataaagtgatgcttagtcattttcttaaactatttgtctgaaatgggaaatttctctaaatcacatataagactgaaaccaactaaaattcatttttctctccaacaaaatcaacgctttaatttgcctgaagtttttctctgaa

SEQ ID NO: 464598 - DNA, 1522 bp, Homo sapiens
catctctccgcgagccgcgggtcaagtgccggcggctaatggtgcgcgaggagccgccacccattcggcgttggctctggcgtcggggtcgttgtgacaaccgctccagtagccgtttccgaggcagcaggtgcggccgctttagccctgagcgggctctgcggctgcctgcgagtctctgctgtgccgacccttctcttcgcggaccccacgccaagcagcgaccctgaggcgacagccggagcgcccggcaatggcggcctcgacggcctcccaccggcccatcaaggggatcttgaagaacaagacctctacgacttcctctatggtggcgtcggccgaacagccccgcaggagtgtcgacgaggagctgagcaaaaaatcccagaagtgggatgaaattaacatcttggcgacctatcatccagcagacaaaggctatggtttaatgaaaatagatgaaccaagccctccttaccatagtatgatgggtgatgatgaagatgcgtgtagggacaccgagaccactgaagccatggcgccagacatcctagccaagaaattagctgctgctgaaggcttggagccaaagtaccggattcaggaacaagaaagcagtggagaggaggatagtgacctctcacctgaagaacgagaaaaaaagcgacaatttgaaatgagaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagaagagatttgttcaacactgcaattgtttgttagatataaaccctgtgactataatacattgcttcttgttctccacaattcatgacttaagtaccaaaatgcataccagttattatatattgccaagaattaaatgataaacttagagactaattagactgaaaatgcctaattgatatatatattcttatgcctagtactttaccacaaatacagtgtaatatcatcagtccaaaactgcattactttcataagaacactggttaatttgtataagatattatagagctttttatgctttagaagttaagcaatatctttgggggggaactaatttattttcatcactcgaaatgtggtagctcttacaaagtttgttgatttgtttttttaaaaatcaaaagccagttgaacaacaggatatatagacttataaatattcaagctgaatcgtattttaacacttctcttcaacttgatttgtctgtttaattgaaaagaattgtaagagttactgttgcattttctgacctactacctttaaaattcctgttgagtttctttgtgtttacaaggaaaggactgaactttttctcatcaaaactagcttttttccccacaaataaattatcaggttaaactttcaccaa

SEQ ID NO: 464599 - DNA, 421 bp, Homo sapiens
  misc_feature (421)..(421): n is a, c, g, or t
cgaagtcatagccaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaaaggtgagacttgaaaggtgaaaatgaattgaagcctgtttctctgtgtcacattggggttaatttcttcttatttcttgtaggataaaatgccagaagttcgacagagttcttttgccctgttaggtgacctcacaaaagcttgctttcagcatgttaagccttgtataggtatgaatattttctactgctattgaaacttctaaaactaggggggatcctctagn

SEQ ID NO: 464600 - DNA, 3032 bp, Homo sapiens
accgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggct

SEQ ID NO: 464601 - DNA, 3214 bp, Homo sapiens
accgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaata

SEQ ID NO: 464602 - DNA, 3005 bp, Homo sapiens
gcaaattcgcggtgactcagtctggtcggctccttgcgctcggcggccgcggcggcagcagcagcagacgttggcggccgggctgccaggagcagttccgccgggtttcactgtccgtgacttccttcggggcacctcaggcagcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggct

SEQ ID NO: 464603 - DNA, 2452 bp, Homo sapiens
  misc_feature (2452)..(2452): n is a, c, g, or t
accgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaaaggtgagacttgaaaggtgaaaatgaattgaagcctgtttctctgtgtcacattggggttaatttcttcttatttcttgtaggataaaatgccagaagttcgacagagttcttttgccctgttaggtgacctcacaaaagcttgctttcagcatgttaagccttgtataggtatgaatattttctactgctattgaaacttctaaaactaggggggatcctctagn

SEQ ID NO: 464604 - DNA, 1925 bp, Homo sapiens
tgttgcgaactccttgtcacccaaggggtaagggaggagccacagtataaaggaatgtctaggcaagtagtcagcaaactatgtcccatggagccaaatttagcccatgacctgcaagctggtgatgaagaaccagaggtacggaaaaatgtgtgccgagcacttgtgatgttgctcgaagttcgaatggatcgcctgcttcctcacatgcataatatagttgagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccactaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggct

SEQ ID NO: 464605 - DNA, 922 bp, Homo sapiens
ggcactgatacattagtgcatgcaggataaaatgccagaactctgtcgaacttctggcattttatcctgcatgcactgatacattagtgtcaggatgttacttcgggctaccagctgttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggct

SEQ ID NO: 464606 - DNA, 374 bp, Homo sapiens
atgccatatatgttgctgccccttattttagggggtggtaataaacagcactggtgaaatcttatgtttattatcatacacaaattctgttggtttctgtttctgagttatttgttgttttttctttattttttctccttccccctcatttgctcatgtcttggttggcgtttggtggtgtataaccgtgattgcgttaccttagcaataacaattggtcgtcttggttacgtttgtcctcaagaggtggcccccatgctacagcagtttataagaccctggtgtgtattattcaatctttttttttaattcatttttcttcactctttctttctctatctcacttttagatatattttcagttggttacaaaa

SEQ ID NO: 464607 - DNA, 690 bp, Homo sapiens
ataatcattatctatactgtggtgcttattccattaaatactgtccattagtattgtcattgaatctgcttgttacttaaatgctaaactcaattctgtaattcaataggtgcacctctctgagaaacataagagacaatgaggaaaaggattcagcattccgtggaatttgtaccatgatcagtgtgaatcccagtggcgtaatccaagtaagatgttcacaaagatttgtttttaatgtctaattaataaaattttaaaggaagaaacattctaatactttaattataaaaagttaactattttcaaaggtatcaaaatacagttaaacctttaaaatgtatatttcttaatatcttgaaattgtaatgccttttttttttcctaaattttttttgtcatgaaatgagatagtaacagcagattgggacaacaaggttatattcttgtcttgaatcaggccatggcttctttcatccaaatttcagacctcatttatttactttgtccctgcctcccatccctggatatcagtttgtggatatctacagttaatagagtgaccaaatagtaggaatactgtctctctattctgaataaaatactttgaatcagatttagaaataatgaataaaatacaaatcagccattgaaattgctctaattttgagagcttatgatttattcatc

SEQ ID NO: 464608 - DNA, 267 bp, Homo sapiens
gacagtgatgttttagatcgtcctctcaacatcatgattcccaaatttttacagttcttcaagcatagtagtccaaaaataaggtacttatattgccagtactaattgattaactgtgatataaacctgaccattatcttagttttcattacctaatatttttgacattagcaaaagatcaaaagatattggatgttccagagaggtgaacttatgtaattgaaattgactacttcagtaacaaaacctgtgaaatgttgactcttt

SEQ ID NO: 464609 - DNA, 320 bp, Homo sapiens
cataaggtcaaaagcttgcttgataataggactgaattgatactaatggtgtgatttttaaactgactaatattaaggatattgtgtttccagtacatgctacagaggactcaagatcaagatgaaaatgtggctttagaagcctgtgaattttggctaactttagctgaacagccaatatgcaaagatgtactcgtaaggcatcttcctaagtaagtgttccctcttataaatgctgccttgttctttaatttcttaagtgattcttcattttcatatttttataaaattcattcttttgccatcagggagtgagattc

SEQ ID NO: 464610 - DNA, 622 bp, Homo sapiens
gaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggtaagcctaagtccagtttgaattatgtaagttggcttcttactactattaggtactaataaggctaggctactttaaggaatttctattttgaaccagataactagtattaaacagccataggccgtcttctaaccccagctagatattttgcaaaatgtttttgttataataaaggtaacagaggccaggcatggtggctcacgcctataatctcagcactttgggaggcttaggcgggtggattacctgagatggtttcaagaccagcctggttaacatggcgaaaccacgtctgctaaaaatacaaaaattagctgggcgtggtggcatgtgcctgtagtcccagctacttggaaggctgaggcaggagaattgcttggacctgggaagtggtagttgcagtgagctgaattcgtgcgattgcactccagcctgggtgacagagcaagactccatctcaataaaa

SEQ ID NO: 464611 - DNA, 903 bp, Homo sapiens
ggcactgatacattagtgcatgcaggataaaatgccagaactctgtcgaacttctggcattttatcctgcatgcactgatacattagtgtcaggatgttacttcgggctaccagctgttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaatgtacccttacaggggaaggtaacataggatacgtacatccacctactggaggcgagagttccgtccttatatcatgt

SEQ ID NO: 464612 - DNA, 3289 bp, Homo sapiens
  misc_feature (3005)..(3005): n is a, c, g, or t
accgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggagngcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaata

SEQ ID NO: 464613 - DNA, 3013 bp, Homo sapiens
accgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaatgtacccttacaggggaaggtaacataggatacgtacatccacctactggaggcgagagttccgtccttatatcatgt

SEQ ID NO: 464614 - DNA, 2974 bp, Homo sapiens
gcaaattcgcggtgactcagtctggtcggctccttgcgctcggcggccgcggcggcagcagcagcagacgttggcggccgggctgccaggagcagttccgccgggtttcactgcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggatagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggct

SEQ ID NO: 464615 - DNA, 1755 bp, Homo sapiens
  misc_feature (1565)..(1565): n is a, c, g, or t
accgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagtaagtgttccctcttataaatgctgccttgttctttaatttcttaagtgattcttcattttcatatttttataaaattcattcttttgccatcagggagtgagattctaaagaagccagacttaattttattgttggtaaagagatttttcaaaaagcaattgcctattttaaaaaaaattatgtgagtatggtttgttctaaattataattgatttcggataatttacagcacagtatttttgtggggtttttttgttttttgttttgttttgtttttaaaaaacaatccttgttatttaaccacagactctattgtgaagttttgttttttttccaaaaaataatttcccactagttgtgatgcaacagaatttagttaacttaatgttaagcccatttttctaaaagtaaagtaatataagctcgtgggaaaaaactaaattgcgacattatatttcgatttcacactgagtatcacggagattnaggcacttaaggcttcgggaaacggataaagggttccgggggaagaaggtcaatttaatgagagatgcagaagcgacgatatcaaggggcaccgtagacggcgcccatctacaagggaggcgcaatacacatttcacaacaattttctttttcttctctctattctcactcccagcggcagagggcggca

SEQ ID NO: 464616 - DNA, 785 bp, Homo sapiens
ggcaatgagcttcggttggggtgttcaggaggggaggaaagaacattccaggccagtgagatgcctaacatgagctccagcgctggacaaactgaccatgggcctccacagcctgggcaggtgtctgtcatcgtggggcagagggaagatgggacaggactggacccgtgccctgggcccctgactccccgcccacagcttttccctcacagcgttttccacttgcactttgctcccgaggacttcctcaagctgagtttggtgcacacggccagtgctcctggcagctgtccagtcatctgcgtggccaagtgctacacacagcaggaaaatgtcaccagagacacgaatcccagcgtgacaaaacaagacacgatcaccatcaggcctgagcccactctacagatggacccggcgcagtggaaagcgggccaagaagcagaggtccaggttccaactcttgattctatcacaaaacactgcacccgaggcagccaggcagcttccgaagacctcattctcctaaacacatccattcctgtttctggcagaacttttgcaaacccatcccagttggatgcagcaacatcagaggggtgattacccccaattgccaaagaggtttccagcgctggaaggaaatttggagatcaaggccgagttggcctcagccaagtgaaatgggaatcaggaccattacaaagaaattcaattaaaataaaagacacatcataaactttgactggaaaactccaaatggaattaatattacgttggtcaaatta

SEQ ID NO: 464617 - DNA, 1914 bp, Homo sapiens
ctgatcattgtaaacttatagcagtttttcttttttttccagtatgaatggcccagatttccttcaggggattaaagagagaaatgaacaacataagaaggaaaggaagaaagaacaaaggccaaatgactgggatttcctggaggaaaggcggtctccaaatagacaaaaacacctgaaactggtaaacagctgcttccgaataagatctcagaggttggggaaaaacgcctcaagtgagcatgcgcacaacttccgtaaacacactgtgcatgtggcccctcccaagtgctggcaggccactgcacgtgcggacagcccaacccaaggaaaaatcagtggggaagaaaaaggggagaaggaatgcaacaccccggaaacatgccaacatataaaaccagcagctatgagtaccatcactgtgctaagaggaatgtgggttcgaatttcagcactagcacttcttcactggatgatattaggcaagaggtttcatctctttaagcctatgttgtagaaaaataccaagctaagatactgaattgtggtaccaagaaggacagagatgaaatcctggataaatggacactaaaataaagcagatctgggtttgaatcctgacttcaatactaccggtgatgtgatttatatgcctaggacttgtgcttctaaggctcaattttatgcctacaaaatctttattaaaatgcacaccttgaagatcactataattaaagaacatatataatgtatatgttatataataaataatttgtctaatctttgcccctgattcctggtagatgaccactaaactaagtctttggaatttctcaagtgatagtagtgtctttgttattcatggtgggaccgtcaagcatgaatggttatgataatagaggactcaggatgagagctgatcaccccagaaagaccaactttgtaatgagaggattgaggatttgagcgaagtgatatctccctgatcaccttcaggaagatgagacaagctgaagattaaattaaagcctgtgaccaatgatacaatcaatcatgcttacataatgaaacatcaataaaaattctggataccaaagttcggtggctcttcctggttggtgaaaacatcaatgtgctagaaggatgccaatgggtgctgcacctgattctacaatgtaagggtacagaagctctacatgtgaaaccctcccagactcctccctatgtgtgtcttcgtttgactagtcctgatttgaacttttatttaaaaaaaaaaagtaattgttagtagagcattttcctgaattctatgagtcattttagtgaattaccagacctgagagagatgtgggaatccctgaatttgtagacaattaatcagagaatgcgtggcccagggactcccaaatttgtggtggacatccaaagcgaggcagtcttactggggactgtgtgcttgtacagtgtctgcgctagctctgagtggttagtatcagaatcacattgcagcattgctgtatataacatgcctagcacagtgtgtggctcataggtaactgatgatgataagcataacattaatattagtattcttatgaatggagcaaaggtaatcaaatacaaaggcaggtaccttcctaacacagctccttaattgtaattgggtaaagttttcaaatattgtgttctttatatttgtttttaattcaagtgatgaatttttaagcatagataattttctcatataatcttatgcacaaaagtttttaaaccctctgcatttactttaattagcaaggttttctctaacagacaatccttgttcttcatgaggtacatcaaagtttactttacctgagaatgagaggtctaagtgatgaacgccttggtaacagaaaatattaacacctgaaa

SEQ ID NO: 464618 - DNA, 2077 bp, Homo sapiens
tcacacgcaggagctgcagatcatggcgtcgagttccactcccaggttgccccgtcagctagtcagtgatggctcttcctcctcctgcctttctgggatcaccaatcagagaagactgttcatggcaatatgacagtgccaccagctggtgctgcctgcaaggactcttttgctgtgctgactacagaatcctgtgtgcctatggtaagcctaggatctgtgaggttagggagctgctgtcctcaacaaatggttctctttggggattaactgggttggcaaagagtgagcaagctcaagaaaacttctgtggtatggtaaaacgtggctttcttggcaaggctacgctgtatatgtgtcaactacagaagtgctactccagtcaatccaacaaatacttccagcagcaattcccaaatggtttattaagagtacgtatttttcatttcaagggagaaccttatcttagaatgccatgagctcttcttctcatctcttctttttaattgctattctttcccctccctgaagccctacaaggaaatcccacctttgtaaagaagagtagccatagaattcaagtggttaatatttgcataatatatcattgcccactctttgaccttcaacttaaccacgtctttatatttgaaagtttcataagttattgtttatgctaagaaagcccattaaaaatttccaagtactgtcttcattttactatttttcaaaattattttgaacaccccaaaagtaagaaacatatataacctgaatatataaacaaggaagtaatttagaaattaaaaacttactatattttcctaattttacctaatttttaatgtaagtaaatttgaagcacattgagactcactggtttaaactgaaatgagaagatttcccttgctgatatagaaaaagaccatataactaggaagccattgatgtgaggaggtcattatattgccctcgagatttcaatttaaaagatactagaatgagtaacaaacatcatccagtttggataatttagaatcattacagaactgtgccttgccttttctgctgttttgtttactgacatttacactgatctttaaaacatcacaaagtatgctgcatgtactaatttgacctagaaatactttcatacaagtacttacatggatattaacattggaaacctaatatccctagatccactttcgtatttaaaacagtactcgtatttaataaacttttctgctcattaacagttgttccatttcacatatgctgttgcacattagacagaagagaacattgagttcttcacaagatactttcggttaagcatgccctgggatggagttaccatgctgacttgatttacttccatgcttctgcatcaatcaagccaggaggctataattagaaaacttccttaaatattaaaaatgtaatcattgcaaactgggtcgagaagtgattaatagggttggacagcttctctcacgcagccatcagggtaaattctcaagatgccaaacgatgaagcagaacttttatggagaccactaacatttactttcagttcttcctgagaaaagtaccaaggcataggttccttaagtgatcttaaattgtctcgtaagcattttatatgtgggaagcacttaggaaataaatgttcaatgaatgaattaatgaaggaatgaatgcaaaaacagctatgaaaaaaagcttaaaaagattctgcctgcttatgcaagatgctaatcatagcattccagaatgctaatggagaattagcccattttgaattttgggaagaggaccagtctgaccatacatacacacttttctcagcacatgacagacagtagcatcctagcagccatcctgtattttgaagatgaatgagtgacaccaaggatgagaaaccaagaagacctcatccttcaaagttcattcatttttattgaagagtaatagtttattgcaacacagtgaaaaggtaacctacagaaagagagaaaaatatttgcaaactatatatcctatgttgattaattcccaaaatatctaagtaatg

SEQ ID NO: 464619 - DNA, 2518 bp, Homo sapiens
tcacacgcaggagctgcagatcatggcgtcgagttccactcccaggttgccccgtcagctagtcagtgatggctcttcctcctcctgcctttctgggatcaccaatcagagaagactgttcatggcaatatgacagtgccaccagctggtgctgcctgcaaggactcttttgctgtgctgactacagaatcctgtgtgcctatggtaagcctaggatctgtgaggttagggagctgctgtcctcaacaaatggttctctttggggattaactgggttggcaaagagtgagcaagctcaagaaaacttctgtggtatggtaaaacgtggctttcttggcaaggctacgctgtatatgtgtcaactacagaagtgctactccagtcaatccaacaaatacttccagcagcaattcccaaatggtttattaagagtacgtatttttcatttcaagggagaaccttatcttagaatgccatgagctcttcttctcatctcttctttttaattgctattctttcccctccctgaagccctacaaggaaatcccacctttgtaaagaagagtagccatagaattcaagtggttaatatttgcataatatatcattgcccactctttgaccttcaacttaaccacgtctttatatttgaaagtttcataagttattgtttatgctaagaaagcccattaaaaatttccaagtactgtcttcattttactatttttcaaaattattttgaacaccccaaaagtaagaaacatatataacctgaatatataaacaaggaagtaatttagaaattaaaaacttactatattttcctaattttacctaatttttaatgtaagtaaatttgaagcacattgagactcactggtttaaactgaaatgagaagatttcccttgctgatatagaaaaagaccatataactaggaagccattgatgtgaggaggtcattatattgccctcgagatttcaatttaaaagatactagaatgagtaacaaacatcatccagtttggataatttagaatcattacagaactgtgccttgccttttctgctgttttgtttactgacatttacactgatctttaaaacatcacaaagtatgctgcatgtactaatttgacctagaaatactttcatacaagtacttacatggatattaacattggaaacctaatatccctagatccactttcgtatttaaaacagtactcgtatttaataaacttttctgctcattaacagttgttccatttcacatatgctgttgcacattagacagaagagaacattgagttcttcacaagatactttcggttaagcatgccctgggatggagttaccatgctgacttgatttacttccatgcttctgcatcaatcaagccaggaggctataattagaaaacttccttaaatattaaaaatgtaatcattgcaaactgggtcgagaagtgattaatagggttggacagcttctctcacgcagccatcagggtaaattctcaagatgccaaacgatgaagcagaacttttatggagaccactaacatttactttcagttcttcctgagaaaagtaccaaggcataggttccttaagtgatcttaaattgtctcgtaagcattttatatgtgggaagcacttaggaaataaatgttcaatgaatgaattaatgaaggaatgaatgcaaaaacagctatgaaaaaaagcttaaaaagattctgcctgcttatgcaagatgctaatcatagcattccagaatgctaatggagaattagcccattttgaattttgggaagaggaccagtctgaccatacatacacacttttctcagcacatgacagacagtagcatcctagcagccatcctgtattttgaagatgaatgagtgacaccaaggatgagaaagtgagtgtggagtcctggacttcccatctccagacctcttacaggaaagaggaaaaggaaacctgtgtcttcttaatgtcatgattatttgggttttttgttcagagaattctgccaaacctaacactcatttaaaagcttatcaagcaattattataaatttattgagtgagcactttctattcttaaaatttgggatttgccctttcattaatagtagaaatataagaaattatccttgctcttttttgaaaatttactttaagaaataaggctgaccttgagcacaatgctgtgtcaaaactctgtcagaaatacacataaacttacataacactccatacttcttttgtggtgaccctttccacatgacttttccttcttaatagtactgtaaggttcttgaaaaagaagctgggtctaattcgtacatcgagtaatcaataaaagcattacagctgtgacacaatgaaaatgatattttttgtctccatggcagtaagatggaatcagtaataacaagtccaatgtaagaattatttgtgataaaaaaaattgtctaccgagtgctttaagttcctaggaaactgtgc

SEQ ID NO: 464620 - DNA, 1461 bp, Homo sapiens
  misc_feature (3)..(5): n is a, c, g, or t
  misc_feature (9)..(11): n is a, c, g, or t
gtnnnattnnnagaatggctaaaggagagtacttccgatgtcacgtaaaaggtgatcaagactgaatatagatcttgacattccatctcggagctagttgctgcttccattccttaccttctgctactgtagccggctaagatgccagcaggttggggaggacaaccaatgatgtttgttgcatcctccatttcagataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgtggccagcttgcagctgtacatctctccaagagccggactgattatcagccaacacaggcaggcagactaatgagaccatcagtgaaatacttgtcacatcctagagttcagtcaggttgtgacaaggaagctctgctgacaggtggtggctctgaaaacagaaatcacaggcttttaaacatggcccgaaataataatgaccctggaagattaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctggaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcagttattttgtaaaaggcccctcaactgagatttgtctgatgttttccccatgattagactgggcttatcggttgtgtcatgggttcccaaaactactgtatttgatgattcgctaagaggactcatagaactaagcatgaattcatacttccagctatgtttttttttaattatactttaagttttagggtacatgtgcacaatgtgcac

SEQ ID NO: 464621 - DNA, 577 bp, Homo sapiens
gtaaagccggagaaggggcggggtctcagctcctacttcattctacggccgagaccggaggatgttccctgctcaggaggaggccgacaggaccgtgtttgttgggaatttagaggcccgagttcgggaagagattctgtacgagctgttccttcagataggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggtaattttaaaaatatttctcatcaaaggtaaagcaaatatatttttatgccaagaggagtttttatatattttgggctattgtaaaaccttactttttaggcctaggataaaattaaggaatatcttttttttccgagcccatgaaaagtgatagaaaatattttcatttaaaattcag

SEQ ID NO: 464622 - DNA, 2056 bp, Homo sapiens
gtaaagccggagaaggggcggggtctcagctcctacttcattctacggccgagaccggaggatgttccctgctcaggaggaggccgacaggaccgtgtttgttgggaatttagaggcccgagttcgggaagagattctgtacgagctgttccttcagataggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgttcaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcatattgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatgtttttaatgaagagagtaactgaattttaatcttggttacaaatatataatatagtgaagtttgaaacataaatatt

SEQ ID NO: 464623 - DNA, 1043 bp, Homo sapiens
gtaaagccggagaaggggcggggtctcagctcctacttcattctacggccgagaccggaggatgttccctgctcaggaggaggccgacaggaccgtgtttgttgggaatttagaggcccgagttcgggaagagattctgtacgagctgttccttcagataggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctaaaaaaaaagtcgacgcagccgcgaatttagtagtagtag

SEQ ID NO: 464624 - DNA, 1889 bp, Homo sapiens
gtaaagccggagaaggggcggggtctcagctcctacttcattctacggccgagaccggaggatgttccctgctcaggaggaggccgacaggaccgtgtttgttgggaatttagaggcccgagttcgggaagagattctgtacgagctgttccttcagggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgttcaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcatattgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatgtttttaatgaagagagtaactgaattttaatcttggttacaaatatataatatagtgaagtttgaaacataaatatt

SEQ ID NO: 464625 - DNA, 3759 bp, Homo sapiens
gaatttgggaagtgggcagagggctctggtcttgccagctgcatggctttctgtgacctgcttgccctccagagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttcagcgatgatggggcgctgggaccagtgctgaccaccttcgaccataccctggaccatgagtccctgaatcctggtgctgtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgccgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggagaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacattcacgcccgataaaacccctatgtgccccggcggccgggcaaggctgtgtacataaggccaagagtaagtgcgtgaatgcacttaagacaaagtcaggacacgagcttcacatgacaggccccgcgtggggcaccagccagccctggggacgggcacgccacgccacacacacactcaccactgtacagcctgggactcccattgcatattcacaggccccgccgggcagggcacctcaaggctgggggaggggcaggggcagggaggagccgtggggtgtccctgggtgggtggagagggcagcatgtgagaggcaaatgtgcaccaacactgggcgtgagacgtgagcagcctcaggtgtacggcatgagatgtgtgtggttggggggtgtctgcgtgacccgggaggggggtgtgtgtgagatgagcacacgaggcatgcgtggcacgtgctcgtgtggtggtcgtgtgcctgaatccaggggctaccccctgtccggctgtggccctcggtcctgcaggcttggagcagggcccctcagacgtgcccctacccagcaggcacagaaatgtttgcataaggtccagctcaggcaggagctctggggccctggcccaggcccagtgtgtgcgtgcatggccgtgtgtatgcggggcccctggagagggacgggaggagaggtagcatcacacgcacatacacacacacagatgggctgggcctggcccaggctccaggcactgtccctcctgggccctggggccgagtggcccgcggccacacctcacgtcttccggcttgtgcagcgtgaggtagatctcatagatcttccctcggggtatggcatctggggggatgaggaggctgattcctggaacggcaggaagagggccagggcttacccactgccaaagcacccaacaccccaccacacagcccctccaggagccttcctgtgaggactgactggtg

SEQ ID NO: 464626 - DNA, 1556 bp, Homo sapiens
gagacgtggcaaaaaagctgggtgagatgtggaataattgaaatgacagtgaaaagcagccttacatcactaaggcggcaaagctgaaggagaagtatgagaaggatgttgctgactataagtcgaaaggaaagtttgatggtgcaaagtcggtcccgggggagaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacattcacgcccgataaaacccctatgtgccccggcggccgggcaaggctgtgtacataaggccaagagtaagtgcgtgaatgcacttaagacaaagtcaggacacgagcttcacatgacaggccccgcgtggggcaccagccagccctggggacgggcacgccacgccacacacacactcaccactgtacagcctgggactcccattgcatattcacaggccccgccgggcagggcacctcaaggctgggggaggggcaggggcagggaggagccgtggggtgtccctgggtgggtggagagggcagcatgtgagaggcaaatgtgcaccaacactgggcgtgagacgtgagcagcctcaggtgtacggcatgagatgtgtgtggttggggggtgtctgcgtgacccgggaggggggtgtgtgtgagatgagcacacgaggcatgcgtggcacgtgctcgtgtggtggtcgtgtgcctgaatccaggggctaccccctgtccggctgtggccctcggtcctgcaggcttggagcagggcccctcagacgtgcccctacccagcaggcacagaaatgtttgcataaggtccagctcaggcaggagctctggggccctggcccaggcccagtgtgtgcgtgcatggccgtgtgtatgcggggcccctggagagggacgggaggagaggtagcatcacacgcacatacacacacacagatgggctgggcctggcccaggctccaggcactgtccctcctgggccctggggccgagtggcccgcggccacacctcacgtcttccggcttgtgcagcgtgaggtagatctcatagatcttccctcggggtatggcatctggggggatgaggaggctgattcctggaacggcaggaagagggccagggcttacccactgccaaagcacccaacaccccaccacacagcccctccaggagccttcctgtgaggactgactggtg

SEQ ID NO: 464627 - DNA, 436 bp, Homo sapiens
tgtaggttagatggttattaataggtttttgcacaccgaaagcctcctggggagtagggagcgggcagagggcaaggccttcaaccatacagcaaagtaggcaaggaattgtgcttggggagggtggaaagcctaggcttgtgatggatgcaggttttgcagaggcagagtgagcctgaaggggcctccagcttcctgccacttcctctcggtctcaccccagggcatcctcctgaactggaccaagggtttcaaggcatcagactgcgagggccaagatgtcgtgagtctgttgcgggaagccatcactcgcagacaggtaggagcctgttctaggggtgctttggggctgtggcaggccttgaggggagcaaagagtctcctactttctgaggggggagccctctgcggtagagacctctgggtccagtgctgg

SEQ ID NO: 464628 - DNA, 3674 bp, Homo sapiens
gaatttgggaagtgggcagagggctctggtcttgccagctgcatggctttctgtgacctgcttgccctccagagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttcagcgatgatggggcgctgggaccagtgctgaccaccttcgaccataccctggaccatgagtccctgaatcctggtgctgtagccatggggctttagtgggatggggagcttctgggctgagccccaaaccacttccctttcccctccagcccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgccgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggagaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacattcacgcccgataaaacccctatgtgccccggcggccgggcaaggctgtgtacataaggccaagagtaagtgcgtgaatgcacttaagacaaagtcaggacacgagcttcacatgacaggccccgcgtggggcaccagccagccctggggacgggcacgccacgccacacacacactcaccactgtacagcctgggactcccattgcatattcacaggccccgccgggcagggcacctcaaggctgggggaggggcaggggcagggaggagccgtggggtgtccctgggtgggtggagagggcagcatgtgagaggcaaatgtgcaccaacactgggcgtgagacgtgagcagcctcaggtgtacggcatgagatgtgtgtggttggggggtgtctgcgtgacccgggaggggggtgtgtgtgagatgagcacacgaggcatgcgtggcacgtgctcgtgtggtggtcgtgtgcctgaatccaggggctaccccctgtccggctgtggccctcggtcctgcaggcttggagcagggcccctcagacgtgcccctacccagcaggcacagaaatgtttgcataaggtccagctcaggcaggagctctggggccctggcccaggcccagtgtgtgcgtgcatggccgtgtgtatgcggggcccctggagagggacgggaggagaggtagcatcacacgcacatacacacacacagatgggctgggcctggcccaggctccaggcactgtccctcctgggccctggggccgagtggcccgcggccacacctcacgtcttccggcttgtgcagcgtgaggtagatctcatagatcttccctcggggtatggcatctggggggatgaggaggctgattcctggaacggcaggaagagggccagggcttacccactgccaaagcacccaacaccccaccacacagcccctccaggagccttcctgtgaggactgactggtg

SEQ ID NO: 464629 - DNA, 1740 bp, Homo sapiens
aggagattaacgggagaagtcctgtagggagatgggcagttaccttctctccgtctctctctcggggactctatttgtggctggtggagctgtcttaaacgaagagaaccatgagcaatgaatcttgtttaccttattacacagcccacagctactcttcaatgagtgcgttcaaaacctccatgggggacctgcaacgacaattgtacaacagaggagagtacaacattttcaagtatgcaccaatgttcgagagtaattttattcagataaacaaaaagggagaggtgattgatgtacacaaccgtgtccgaatggtgacagtgggcatcgtctgcaccagccccatcctcccactgcctgacgtcatggttctggcccaaccaactaaaatctgtgaacagcatgtcagatggggccggtttgccaaggggagaggtcgcaggcccgtcaagactctagagctcacgagactgcttcccttgaaatttgtgaagatctccatccacgatcatgagaaacagcagctgcgcctgaaactcgccactggccgtactttttatctgcagttgtgtccctcttctgacacacgggaagatctcttttgctattgggaaaaacttgtctatctcctgaggccaccagtagagagttactgcagtaccccaacacttctatctggggacgcaccacccgaagacaacaaaagcctagtggctgcagagctccacagagaaggggatcagagtgagactgggctctacaagccttgtgatgtatctgcagccacctcttctgcttatgctgggggagagggaatccaacatgcctcccacggaacggctagtgcggcttctccatccacgagcactccaggggctgctgaaggaggagcagcaaggacagcaggtggcatggcagtggcaggaacagcaacaggacctagaacagatgtggcaatagcaggggcagcaatgagtcctgcaacaggtgctatgagcatagcaacaaccaaatctgcaggcccaggtcaagtgaccacagcgctggcgggagcagctatcaaaaatccaggagaaaatgaatccagcaagtccatggcaggtgctgccaacatatcctcagagggtattagcttggccttggtgggtgctgcaagcacctccttggaaggtacttccacctcgatggcgggggccgccagtctctcccaagacagcagcttgagtgcggcgtttgcaggcagtattacgaccagcaagtgtgcagcagaaagaactgaaggaccagcagtgggacccctcatctccaccttgcaaagcgaaggctacatgagtgaacgagatggaagccagaaagtttcccagcccagtgctgaagtctggaatgaaaacaaggaaagaagagaaaagaaggacagacatcccagtaggaaaagttctcatcaccgcaaggcaggtgaaagtcaccgcaggagagcgggggacaagaatcagaaagcgtcttcccaccggtccgcatctggccataaaaacacgagagatgacaaaaaagaaaaagggtacagcaacgtaaggggcaagcgacatggctcctctcgcaagagctccacccacagctccaccaaaaaggacagcagtaccttggaggacagaagttgggtttccggcaaaacttagggaccttttctgaacaccaaatatgtgtagccaagatggaggaggtgagaagcgacgtatt

SEQ ID NO: 464630 - DNA, 2266 bp, Homo sapiens
ggcaaatgagagccaagcaagttggagctgcccgggaactggatgtgcttgcttagaaaacatttcaacatttccaagggtatagtttctcacacatactctggaacgcttggaaaccactttaattagcattgttggcctgtctggctgccttgggtctttggttcgctgagggctgcatggaggctacaccctcctctccagcacctgcgatgggaagtcacaggagaccggaggtgcgcacgacatcacagagccgagttctgacccaatctgaatcaaatgtcacccataccctatcttcaacaaacaaaagagcaacgaagccagagacaccatcttcagatgccttggcctgtaaggaattcattctgacttgcgatgtgctttaacactttcacatgtaattgtgtccggaattggtgggttcttggtctcaccgacttcaagaatgaagccgcggaccctcgcggtgagtgttacagctcctaaggtggcgcgtctggagtttgttccttctgatgttcagatatgtttggagtttcttccttctggtgagttcgtggtctcactcgctcaggaatgcagctgcagaccttcacgctcccctaatcctatggaataattcaactcgtgaatgcatctggagccctagatgaccgctttataaggcagccctcggagttgggaggctgcagtctacctgggacactcgaggaggcacacgaggcggaaaagtggacgggtgccccgcgccaccgcctctcccgagggcgcgtactgaccaggatgtcagacaagctcaaggaacgcaaaagaacccccgtttctcataaagtgatagaaaagcggaggagggacaggatcaaccgctgcttgaacgagctgggcaagacagtgcccatggccttggcgaagcaggaggctctggcgcagatccgcagccgcgtccgctcgctggtcctctccagcgccacagtgcccgaccagcaggcgctgggccgctgcgaggggcccttcctccttttgcagagttccgggaagctggagaaggcggagatcctcgagatgaccgagggcaggggtcctgcgaaggcgcctctccctgctcggcgacagcaaggcggcgagggagaactggttcccagggaggctgcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagggttcaaggtaacagccctcagtaacttggtgaggggcccgctgtggagtctgagggagggggacgttaaatggaggttcaggcagatattctaggcatcgcttaagggcgggattcgcggcttcctgcacccgccccatcttgagcattagcctcagagaaacaggggaggcgaagaacactgcccttggctctcaggaaaatgcaaattgaaggacctgccccaaactgacttaggcggaccgttgccagctgcgacccgggcgcccgtcctacccggagccaagtgcccgacgcgcgcgcaccgcacgcccgcgggtctggaatgcggcgaaacccgggccagcggggcgc

SEQ ID NO: 464631 - DNA, 495 bp, Homo sapiens
aggcgcttgctcgcccgccggccccagtttaccgcctccttttcccgcccgagctgttgccatgcaaatgttattcctgggccgatcacgtgtcctttgaagggccacgtggattaacaaagctgatctgcccccagctcgcccccctcggctgctaattttttttttttcttaacttctttaaaactgatcttgaatgcatacatcctccaaacgcagctcccctaatcctatggaataattcaactcgtgaatgcatctggagccctagatgaccgctttataaggcagccctcggagttgggaggctgcagtctacctgggacactcgaggaggcacacgaggcggaaaagtggacgggtgccccgcgccaccgcctctcccgagggcgcgtactgaccaggatgtcagacaagctcaaggaacgcaaagtgagtcggctgagcccaaatggcacttgcgccctggtggtggaggcatctgactcaccgacc

SEQ ID NO: 464632 - DNA, 948 bp, Homo sapiens
ggcactaataaatttagtatcaaatgtataagtcaatgtttttgaatgacttaagagtgaaggttatagcattaataaaagacaatgtttatggaattgaattcagagacaaaagacagtttgttgctcatggcaatagtggtagccacaataccattgttttcacactgactctctatggcccaattcccacagggcagaagcaaatgggccaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcagctattgatacttgtgtatgcttcacgaagttcttgtgttgtgttttt

SEQ ID NO: 464633 - DNA, 786 bp, Homo sapiens
  misc_feature (14)..(14): n is a, c, g, or t
  misc_feature (28)..(28): n is a, c, g, or t
  misc_feature (53)..(53): n is a, c, g, or t
caaagttcaatttnccaaaaagtgaacnattcaagaaaactttatcatactangaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcagctattgatacttgtgtatgcttcacgaagttcttgtgttgtgttttt

SEQ ID NO: 464634 - DNA, 368 bp, Homo sapiens
ggctaaacgcaaccaggaacacattggcaaacttttgcgcctgcgcccaccgggcgtgcacctgtaggctgaagtcgcgcatgcgctagatgggaacgttgtttcttctcccctaccccttttctgtggggctgttttagggacagactgcttccgggtcgaagggcttgcttccggagagcgggaaggctaaaacgcggtagctaaactgcagccaactttggttgtgtgtggaaaaggctttagccatggacaggtcagtactgatggtggcagctgagcccgaagtcttgcccgtctcgcctgttggcgaaacgaaataggtgaaactagactcccagaagaagccaaggaggtcccgggtgctt

SEQ ID NO: 464635 - DNA, 443 bp, Homo sapiens
cagcagggaaagcagtgactcagcgcacttcaagtatggtgggctgggggaggcactgccctcaggctcataccccaggtccagatccgagcgcctcggagtggccgtcgaagtctcacctttaatgccaacacctttcaagaagcaggaactggccagttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctggtaaaatggcattgagctttgtgacaagtagcttttcactttagcaagatgaaggaaaccatt

SEQ ID NO: 464636 - DNA, 2721 bp, Homo sapiens
ggctaaacgcaaccaggaacacattggcaaacttttgcgcctgcgcccaccgggcgtgcacctgtaggctgaagtcgcgcatgcgctagatgggaacgttgtttcttctcccctaccccttttctgtggggctgttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacgaaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggtaaatgttctttgaaatgaaagttgccttcaaagttaactgattttttttttcaggctgagaattttttctcgtggatctttgttttgctcttctaaaggtttgcacacactaacattttactctaaaacaactaagttgcattggaatctgatggaatatattgaaacatatccgtgacctttgaattgtaagtaataagttgtggaaagtatacttaacttgacagcattaaaaacaaattaattttggtcttatcttaagatttgactgcctatataaggtagtgactgacctatgaaagctcttttatgttgaaagcaagtgaaaaaaaactaaagccttattggtttgaggttagaacggttatttgaaaagtggatttgaaaagaactgaagctgaattattctaaaaacaaaggaatgaagctttatgacagggcacgtgaaatgtttatagtgaaaagagagaaataagtaacaattgaaaaaaacttctagaattccatttagtaacaaagaggtttttgatgaaaattgtttgggaaaaagaaaaagaaaattgtttggaaactactcttaacagcttaaaattgattatagctaaattacattgtagcaggcaacagctgaaaatcgtttaatcttaccagctggaaagtggtgatttccttttgccagaaagagaccatgttccaaaattgaattatgtgtttgcaaaatatttatgaaagtagtgaattgatctattatgtattccattttctgaattgatattcatattaccatacactaagtaacatgtggagtaagaattacttcctttcttgagtcacattaaaattgttttccattggaagtccatcatgtagatcatgtgtgctgtttgctgctaaagtgagaacaatatattatcctaaatgcttagaagcacatggaaaaaaggtaggtagaaataactgttttgggagatttgtacttatttattagaaatctgtttaaatttttttattaggcattggtgttttttatgtggcattaatcccaaaataggtcttaataggccctcttcccatatgttctcaaaaagtaccagaagcctaaatttaaccagttggaattctttttttaggtgttattctattcaacctttaaaaatgaaggatctgattttaatgtgaaatctgcatttcatcaaagatgggacacagtgtccttgcttaattattctttggaaattgaacacctttactactgcattcttagcaggtagcaacaacacaaattgaagaaaatgtgattcaggtttgaagcactgagttcattgatttcaaccatattgataagcatagagaatacaccttgcattgatactgctcacatgctcaactagcagatggtgtagtagtcaatgataatgtcactaaatgcctacacatataaggagaatttagagtgtgaatgaggaaaatcataacatttcacaattgtgtgacactttctaaagtcttatctattatgccatcttattcttttgtcatccatgggagagagacagccaggaggcctcaggtaagcagaccatccagctcacagatgttgaagccaaacttgaatctcacctttccaaagcactgttctttctgtca

SEQ ID NO: 464637 - DNA, 440 bp, Homo sapiens
aaaattttcaaaaacagccagtatgctctggcttcttcaacaggagatggtcacatggaggctgctggcttctttgtataggtaatggcgtctagaattcataagtgaaataaacataaggtaataaaccaacaggcaaattaatttaaaagttagggtaggtcgtgcttggaaataggttttgctatttttgatgcttatcatttcgaataccttagttgtcaagagtgagtcaagagggaagaggaagatatcagatcataaggctggtagttaccaaaattggatgtgtgtaaagacttaaggaaagtactaaaaatagtgcaatacttaggctaaattaagaaaagagctgaaagttagacttcatgtaatatggaagtttgaaagaagttaaccaaattttccagaaggcgaagattataccatgtacatatcct

SEQ ID NO: 464638 - DNA, 2866 bp, Homo sapiens
ggctaaacgcaaccaggaacacattggcaaacttttgcgcctgcgcccaccgggcgtgcacctgtaggctgaagtcgcgcatgcgctagatgggaacgttgtttcttctcccctaccccttttctgtggggctgttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacgaaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggtaaatgttctttgaaatgaaagttgccttcaaagttaactgattttttttttcaggctgagaattttttctcgtggatctttgttttgctcttctaaaggtttgcacacactaacattttactctaaaacaactaagttgcattggaatctgatggaatatattgaaacatatccgtgacctttgaattgtaagtaataagttgtggaaagtatacttaacttgacagcattaaaaacaaattaattttggtcttatcttaagatttgactgcctatataaggtagtgactgacctatgaaagctcttttatgttgaaagcaagtgaaaaaaaactaaagccttattggtttgaggttagaacggttatttgaaaagtggatttgaaaagaactgaagctgaattattctaaaaacaaaggaatgaagctttatgacagggcacgtgaaatgtttatagtgaaaagagagaaataagtaacaattgaaaaaaacttctagaattccatttagtaacaaagaggtttttgatgaaaattgtttgggaaaaagaaaaagaaaattgtttggaaactactcttaacagcttaaaattgattatagctaaattacattgtagcaggcaacagctgaaaatcgtttaatcttaccagctggaaagtggtgatttccttttgccagaaagagaccatgttccaaaattgaattatgtgtttgcaaaatatttatgaaagtagtgaattgatctattatgtattccattttctgaattgatattcatattaccatacactaagtaacatgtggagtaagaattacttcctttcttgagtcacattaaaattgttttccattggaagtccatcatgtagatcatgtgtgctgtttgctgctaaagtgagaacaatatattatcctaaatgcttagaagcacatggaaaaaaggtaggtagaaataactgttttgggagatttgtacttatttattagaaatctgtttaaatttttttattaggcattggtgttttttatgtggcattaatcccaaaataggtcttaataggccctcttcccatatgttctcaaaaagtaccagaagcctaaatttaaccagttggaattctttttttaggtgttattctattcaacctttaaaaatgaaggatctgattttaatgtgaaatctgcatttcatcaaagatgggacacagtgtccttgcttaattattctttggaaattgaacacctttactactgcattcttagcaggtagcaacaacacaaattgaagaaaatgtgattcaggtttgaagcactgagttcattgatttcaaccatattgataagcatagagaatacaccttgcattgatactgctcacatgctcaactagcagatggtgtagtagtcaatgataatgtcactaaatgcctacacatataaggagaatttagagtgtgaatgaggaaaatcataacatttcacaattgtgtgacactttctaaagtcttatctattatgccatcttattcttttgtcatccatgggagagagacagccaggaggcctcaggtaagcagaccatccagctcacagatgttgaagccaaacttgaatctcacctttccaaagcactgttctttctgtca

SEQ ID NO: 464639 - DNA, 2596 bp, Homo sapiens
taaatccttgtatcatggaaatgttaacatttaaagtatttatttggttagagtctaaataatggaaaactgaaaaatttattcttcattgtttgtttgcttactttgttttgataatgaatgctcacgcactttaggttctttctaccaaccttttgtttatagttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggtaaatgttctttgaaatgaaagttgccttcaaagttaactgattttttttttcaggctgagaattttttctcgtggatctttgttttgctcttctaaaggtttgcacacactaacattttactctaaaacaactaagttgcattggaatctgatggaatatattgaaacatatccgtgacctttgaattgtaagtaataagttgtggaaagtatacttaacttgacagcattaaaaacaaattaattttggtcttatcttaagatttgactgcctatataaggtagtgactgacctatgaaagctcttttatgttgaaagcaagtgaaaaaaaactaaagccttattggtttgaggttagaacggttatttgaaaagtggatttgaaaagaactgaagctgaattattctaaaaacaaaggaatgaagctttatgacagggcacgtgaaatgtttatagtgaaaagagagaaataagtaacaattgaaaaaaacttctagaattccatttagtaacaaagaggtttttgatgaaaattgtttgggaaaaagaaaaagaaaattgtttggaaactactcttaacagcttaaaattgattatagctaaattacattgtagcaggcaacagctgaaaatcgtttaatcttaccagctggaaagtggtgatttccttttgccagaaagagaccatgttccaaaattgaattatgtgtttgcaaaatatttatgaaagtagtgaattgatctattatgtattccattttctgaattgatattcatattaccatacactaagtaacatgtggagtaagaattacttcctttcttgagtcacattaaaattgttttccattggaagtccatcatgtagatcatgtgtgctgtttgctgctaaagtgagaacaatatattatcctaaatgcttagaagcacatggaaaaaaggtaggtagaaataactgttttgggagatttgtacttatttattagaaatctgtttaaatttttttattaggcattggtgttttttatgtggcattaatcccaaaataggtcttaataggccctcttcccatatgttctcaaaaagtaccagaagcctaaatttaaccagttggaattctttttttaggtgttattctattcaacctttaaaaatgaaggatctgattttaatgtgaaatctgcatttcatcaaagatgggacacagtgtccttgcttaattattctttggaaattgaacacctttactactgcattcttagcaggtagcaacaacacaaattgaagaaaatgtgattcaggtttgaagcactgagttcattgatttcaaccatattgataagcatagagaatacaccttgcattgatactgctcacatgctcaactagcagatggtgtagtagtcaatgataatgtcactaaatgcctacacatataaggagaatttagagtgtgaatgaggaaaatcataacatttcacaattgtgtgacactttctaaagtcttatctattatgccatcttattcttttgtcatccatgggagagagacagccaggaggcctcaggtaagcagaccatccagctcacagatgttgaagccaaacttgaatctcacctttccaaagcactgttctttctgtca

SEQ ID NO: 464640 - DNA, 1495 bp, Homo sapiens
ccccaccttaggagccctttgtgagggggaggccccagctctgtgatgtggacctgggccccaataacttgtcccagaggggatgcccagggctcagttgcctgaggacagcagtgcagttgacatggatattctctttcctctggacagtgttatcggtacagagctgtgccccagccccattccccagatcatccatttcgtcctctttgttgtgttcagcctggtgatcctgattatcttacgcctctacattcccagggagccgtcctcagtgcctcccagagaggaggacagcgagaatagaaggaaaccagaaaaaggttattacgcactttagaaaccagtgaaagagaagcacacaggctccatgagctgggcggagaaagtgtgtcattcacgagcactgggtctgcagctgtggggacaggagactgagacccggcctgcaccctctttcttgtctctcaggatcaagctgaagtgggggaatggctcaggatcggaaataaatatatcactttgaaagattacagaattctcttgaaagaactggagaaccttgagatctacactttcctgtcgaaaaagtgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccgtagagtccttggggtctccatcatccctgagctcctccaagccacgagagcctctgtgtcccctgaagcacccttcacaccagccacctgcgagcaccctatcaccaaacccgaccagctccacagaatccttggggtatctgtcatccctgagctcctcccagccaccagagcctttgcgtcccctgaagcacccttcacacaagccacatgggcgttcccctccccgacgacggaatcctggctgggtgtcctggtccgactccatgcaggctgattccgaaactgacgccataatatgcccaatgtgcaaggcccctgagcgctcctgtccacacacctggtgggtgccttctagccctcgagtgatccgaggcgttggtcgctgcagtgatcccaacctgggcctctcctggaggcaggaggctgctagagcctggtgccactgcacctcctcacagtacccattcgagcaccctaatcttcccacccacctaccaaaggcttccttctagggagaccccacatgcaggcagatggaggcagggctcacactggcctccagggctgtgcaactggcatattattttgcacataacttggctcaggtttgtgaggtctgatttttaaaatgaagcaacaatcacataaagattttcaaacaaataagtcaaatgtatggcagtatttctattttat

SEQ ID NO: 464641 - DNA, 1328 bp, Homo sapiens
ccccaccttaggagccctttgtgagggggaggccccagctctgtgatgtggacctgggccccaataacttgtcccagaggggatgcccagggctcagttgcctgaggacagcagtgcagttgacatggatattctctttcctctggacagtgttatcggtacagagctgtgccccagccccattccccagatcatccatttcgtcctctttgttgtgttcagcctggtgatcctgattatcttacgcctctacattcccagggagccgtcctcagtgcctcccagagaggaggacagcgagaatgatcaagctgaagtgggggaatggctcaggatcggaaataaatatatcactttgaaagattacagaattctcttgaaagaactggagaaccttgagatctacactttcctgtcgaaaaagtgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccgtagagtccttggggtctccatcatccctgagctcctccaagccacgagagcctctgtgtcccctgaagcacccttcacaccagccacctgcgagcaccctatcaccaaacccgaccagctccacagaatccttggggtatctgtcatccctgagctcctcccagccaccagagcctttgcgtcccctgaagcacccttcacacaagccacatgggcgttcccctccccgacgacggaatcctggctgggtgtcctggtccgactccatgcaggctgattccgaaactgacgccataatatgcccaatgtgcaaggcccctgagcgctcctgtccacacacctggtgggtgccttctagccctcgagtgatccgaggcgttggtcgctgcagtgatcccaacctgggcctctcctggaggcaggaggctgctagagcctggtgccactgcacctcctcacagtacccattcgagcaccctaatcttcccacccacctaccaaaggcttccttctagggagaccccacatgcaggcagatggaggcagggctcacactggcctccagggctgtgcaactggcatattattttgcacataacttggctcaggtttgtgaggtctgatttttaaaatgaagcaacaatcacataaagattttcaaacaaataagtcaaatgtatggcagtatttctattttat

SEQ ID NO: 464642 - DNA, 452 bp, Homo sapiens
ggctcagttgcctgaggacagcagtgcagttgacatggatattctctttcctctggacagtgttatcggtacagagctgtgccccagccccattccccagatcatccatttcgtcctctttgttgtgttcagcctggtgatcctgattatcttacgcctctacattcccagggagccgtcctcagtgcctcccagagaggaggacagcgagaatgtaaggagccctcagcccacacccagcagagaatgcttctatttttcctgctctcttttccacttttccacatcagccagaggcgctcctgtgatgggaactctcatcatccctctagggacagcagggcaggcaggggttggagtgggcataggatttccaacccaagcccccagaccatctgtggaggtgcacgggaggcgtcagagcaaaaccaaaccccaggactcagcggcga

SEQ ID NO: 464643 - DNA, 1051 bp, Homo sapiens
ccccaccttaggagccctttgtgagggggaggccccagctctgtgatgtggacctgggccccaataacttgtcccagaggggatgcccagggctcagttgcctgaggacagcagtgcagttgacatggatattctctttcctctggacagtgttatcggtacagagctgtgccccagccccattccccagatcatccatttcgtcctctttgttgtgttcagcctggtgatcctgattatcttacgcctctacattcccagggagccgtcctcagtgcctcccagagaggaggacagcgagaatgatcaagctgaagtgggggaatggctcaggatcggaaataaatatatcactttgaaagattacagaattctcttgaaagaactggagaaccttgagatctacactttcctgtcgaaaaagtgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccgtagagtccttggggtctccatcatccctgagctcctccaagccacgagagcctctgtgtcccctgaagcacccttcacaccagccacctgcgagcaccctatcaccaaacccgaccagctccacagaatccttgggggagaccccacatgcaggcaggtggaggcaggggtcccgctttcctcagcctggatgtgccaacgctgctggacgcataagacaccaaaatcccagacactcccatggacaccgaatatccgacatccacgaacaatgggaatctcctgaggacaacttggagatggagtctcactctgttgcctcaggctggagtgcagtggaccatcttgggtcaccaaacttcgctccggattcaagccattctcctgctcagctctgagtaccggattcaggcttgtgcacg

SEQ ID NO: 464644 - DNA, 1230 bp, Homo sapiens
cctcagtttccttgtttgtaaaatagttgaactaaatcttgaccctttaatgcttgttttgaaatccaaggcaaaaaacaattgcaagcgcccttacttccgtgttgcttcatactcctcttgcgcctgcgctgtctccttggagcagaggcggggccaacaagcctgttttagaaaccctccagtccttagctcgtttagaacacaagactccaagcttattggagggctatcttgccttacggctccaagccgctttttacggcgtttttcagctcgccattcacttcgctgtgaagatggcgtcgggcagcggggtaggtgttgtgtctgaggaggaggttttgcggggtggggaatggtttttcagacctgaatagagacaaactcctgcacccgactggcttcccgatatctcctcgagatcccagggttcaggttcaagaactccccagtaataggccttggcagagggtcagtagaatcgcggaggtttctcgggttggggtcttgaggctacctcagtcttctcgtacagtccaaagaggctttgctttcaaaacgtcctgtagacacctggaccgcgagggcgcggttccctgcttctctaggggcccagacacggcgacggatcttgacgctttttcctccccacagacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggtgactgctgagaaggagacagtaaaccggggacacacctgcggaagagctcttcagggattaggaaaggctacgtccttgtcactgctgtgtgtccccagatggacaactcctcaattgtctggaggtccatttgatccagtgctgagttcaggtcctgaatagctttgttaattttctgacttgatgcttagtctagtactgtcagc

SEQ ID NO: 464645 - DNA, 2424 bp, Homo sapiens
ccccacttttgctcacagctcattggccagagctagtcacatgctcttcctggtcatgatgggaacaggaagtgcacctccccttgccctcctccagcttcctctgacggtgggactatgcgaggccttagatgacgtagagcttggcttctgcatctcacctgaaaactgcggtgactttgtgtggaaactcacgcagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgcaccattcggtggcatttagtacatttgcaatattgggcaaccatcgccactacccggtcccagagcttttcatccctgcaaaaaggaagcgccatttatcagtcacctctcccctccctcctcgccccatcccctggctagcaccaacctgctttctgtctctatagagttgcctattccggaatttcatataaatggaatcatatatatgtggccttttgtgtctgactcacttcattcagcagaatgtttccaagggccatcctgtgtggcatctatccacattccatttctctcgatcgctgaataacctcccgtcgtgtgggtgtgccacatttggtgtatccgtttctccacggagggacatttggttggtttccaccttttggccgtcgtgagtcacgccgctgtgaacatttgtgtataaggttttgttcgaagacctgggaattggtgtttttaagatgtgcccagacttaatgaagggttagaagtccgaagtgagttgttggtaagttgctgggggcccagtgaggccagaaccacccagctattccccttcccacaggccctcagcagaaggagcggggcagaacatctgccgtggccccagggggagcttcggaaaagctgagttggagaacaaggccagctaagcatggctccccgcccgccgcacccaccccaggcagggaggaggcagagggaatgggaggcaggccctgcacaggcatgctggttcagggagcaggagcaggagcaggagctggtggggcccccatatgtgtgtgtgtggctggcctgcaccccagctgattgccccctgcttttcctgcaaggtagaagtggggcagagggaggtctggtaaggacagtgagcagatgcaaccgaagtgtccccacctcacagagaccacccacctggccgcagcccttcactcattttggtggtaggatcctctgcatttagcccagtaagtgaaattgccttttatgtattaaagatagttgtgctgactgaggggcagagctggggctctgctcagcctcccctggttcccgaggagcacaggctggaaccgacctagatcaggattcggtgtggggatgttgggggaacgtggaagacgggctcctcccgggctgctgtcagaatccctgaatgtgggtctgtatgtttccctgtcctgtgcatcactgttctctcacgctgtgattttacatctggaaagcaatcatcttctctcccaccctttccc

SEQ ID NO: 464646 - DNA, 1466 bp, Homo sapiens
gatagggaaatgagacttaaccccaaaatccacagtggtcttacactttaccaagacacagggtacaaaattccccctgggaatgacaaatatcaaaaaccaggatcaaaagtcctcaacatcaacgggcccttggtggagaggaaaaaaaacaccgtggtgttattcaacagtacctccagaccagtccctggggaaattgttccaagttcctcaaacagtggagccagtaaaattgaaagagtaagactacctcttgggggcctaaaatatctgtggccactatgcgaaaatatcaggtcagaccacccaagatttccagagtggtattcattttcattgatggcttcttcaaccaggagcaggccacaggctagagtggtagcgatggagagcagagaggtggttcccagagcagcagtcatgagaggagacgggccagtgagcagcctgaaagcagaacacacaacaacagcaggaaagctacaacagctgcagaggaccatgtggaaagggagatgcctcaatggtttagaattctatattaaaaacagtggtggtttggaagaagccccaagataactgctaccaaacctgtgaaatataatttaggtgcctcaaacatgcctctgtgacctgaggctcttcctgctgcctggaacgttcctcttgggctgaagtgagaccaacttcttattcttcaggtgatgatggacaagtcccttaagccttctgatcagcagcttcttgaactctaaaatgggaaatctaatattaatgatatcctacaacatggactgttgtgaaaactaataaagacaaagccttctcaagcactatgaagcattcagtgctaagtacaatgaaaataatgtggccagaggcctcgggcctgtgccagatggaaccagctttggccactctttcccatactgctgctcccagctgacagaggtttggctgaagattctgcaaggacccgtgcatcagtattcccacaaggagctgcagggcacacacaagtgtgtgctgagaaagcccccaagaaagatggaacccacgtgggggcattgctaatgctgtcccagaaaacaagcccagggattttcccagctctatacattgctttgtgtttatcagtgctttgaccagcagctattcatttgtgatatgaaactcttaaaataaaatcttttttattttagcaagttttattgagggaacctggctgcaggcaggatttcagtcttatatctgcataaagcctaaattgttggcatgttgaaatatttccttagaaaaaccaaggtgtttgatgttgcttagccacaccaattgactggacttctcacttcctaaccagttgccttggtgttgcttagatgaagcccagattaatttttttctcggtcacttcttataaaatctgaaatctgaaagttcagccctaaccacctcacaaaatg

SEQ ID NO: 464647 - DNA, 1180 bp, Homo sapiens
ttaccctggagcgcagtggagcatcactgccaacggacttaccctcaacatgccagcacaaattctgtcttctctgctgccatataagatatgacctgctcctccttgtcttctaccatcgttgtaagtcctccccagccacatgaaactgtgagtccattaaacctctctctttataaattacccattatcagagacttggagtgctcagaagacaggcagatgtgggagagtttggaacttcctagagacttgttgaatggctttgtccaaaatgctgatagtgatgtgaacaataaagtccaaaatgatgtgatctcagatggagatgaggaacttgttgggaactggagcaaaagtgactcctcttatggagagaataatggattcctgggccaggtccagggcccccctaaggacttggtatcctgtgtcccagccactccagctgtagctaaaaggggccaaagtacagcttggctgtggcttcagggaatgcaagctccaagctttgtcagctcctacatcgtgttgagtctgcaggcacacaaaagtcaagaattgagatttggaaacctccacttagatttcagaggatgtatggagatacctggatgtccaggcagaagtttgctacagggggtccaggttgttctctggattatcgctaaagaaatctattacactgagagtgaatcaggtatgtttctcacagaaaggcagcatggcactgagagaggctatgaggaaaactgccctggccttcctagagatctggacatccaaatacaagaagctcaaagaacacctgagaaattcattgcaaaaaggtaatcacccaggtacacagtcatcaagttacctaaagtcagacaaaggaaataatcttaagaactgtgcagcaaaagcatcaggtccacattttcaagttgttttaagataatactatttattttcataaaacaggaggttcctttgtcaacgaattcacaaagctgtaagcaaagccaatggaagaatatgtcagatactgagtttatgacagacaggagtcttgctctgttgcccaggctggagtgcagtggtgcgatatcggccaataaaccacatttttgcattcaactacatgaaatgttgattaaagtcttcgagaataaacaatagcatcagcagcaacaac

SEQ ID NO: 464648 - DNA, 2192 bp, Homo sapiens
ttaccctggagcgcagtggagcatcactgccaacggacttaccctcaacatgccagcacaaattctgtcttctctgctgccatataagatatgacctgctcctccttgtcttctaccatcgttgtaagtcctccccagccacatgaaactgtgagtccattaaacctctctctttataaattacccattatcagagacttggagtgctcagaagacaggcagatgtgggagagtttggaacttcctagagacttgttgaatggctttgtccaaaatgctgatagtgatgtgaacaataaagtccaaaatgatgtgatctcagatggagatgaggaacttgttgggaactggagcaaaagtgactcctcttatggagagaataatggattcctgggccaggtccagggcccccctaaggacttggtatcctgtgtcccagccactccagctgtagctaaaaggggccaaagtacagcttggctgtggcttcagggaatgcaagctccaagctttgtcagctcctacatcgtgttgagtctgcaggcacacaaaagtcaagaattgagatttggaaacctccacttagatttcagaggatgtatggagatacctggatgtccaggcagaagtttgctacagggggtccaggttgttctctggattatcgctaaagaaatctattacactgagagtgaatcaggtatgtttctcacagaaaggcagcatggcactgagagaggctatgaggaaaactgccctggccttcctagagatctggacatccaaatacaagaagctcaaagaacacctgagaaattcattgcaaaaaggtaatcacccaggtacacagtcatcaagttacctaaagtcagacaaaggaaataatcttaagaactgtgcagcaaaagcatcaggtccacattttcaagttgttttaagataatactatttattttcataaaacaggaggttcctttgtcaacgaattcacaaagctgtaagcaaagccaatggaagaatatgtcagatactgagtttatgacagggccttgccattgttcatatcataaagctggtctatcatgcccagtgcttggacagaagaagaagagagcaatggagacagcccacctgctgggttaaaggcttgagcattacagcagcacattcagctctcattttattaaaaagaatttggtcaaatgaccacactgactgcaagagaggctagtaaagtagttttgctgtgcatccaggaagaggagcagaaatgattttgtgctacagtcatctacatgtaatacacatcaacaaacaaaaacatgtatgtttccaacatatatgtttggagacagagtctcgctctgtcccccaggctggagtgcactggcacaatctcagctcactgcaaccttcccctcccgagttcaagtgattctcatgcctcagcctcccaagtggctgggactgcaggcacgcgccaccacacctggctaatttttgtatttttagtaaagatagggtttcgccatgttggccaggctgatcttgaactcctgacctcaaaaaacaaaacaaagcaaaacaaaacaaaacaaaacctcagaactaattggattaggatcccaccataataggctcattttaaattaatcacattaatcacttctttaaacacaattaccgtatttccaaatagggttacaatctggagtactggctgttgggactcgaacatatgaattttggggtgacacaagtcaactgagtacattctgtactctccctaaaataaaagaagtttaaaaacaattgctgtcagtcatttggctgtgtcatcatctaagctatctaatgataagagaaacagcagtaactgttagcataccgattgtataaacttgggggatatttatgaatacaacatcagtgtgaattaccagtttaaggactttacagagaaaaaagaggaaggaaatttatgtcttcaagtccggatatttagatgtgtgcttgaaagtttttggtccataatggatcagggtttaaacaaagaaaacaacgggtctttcatcacactatgttgagaagtaacaacctaatctaactgtgggtagaatatagctatccaggaggagagaacagcttggatggctcttgaatcataagaacttacatccccttcaatgaaa

SEQ ID NO: 464649 - DNA, 1205 bp, Homo sapiens
gcagtctgcaggctgctgcagcaaagcgggcctggagcttaagaaaagagccaaggcaagagagagagacttgggagtctcccccagaggtgaggccatgaaggggagagtgcagagatgaagggaggaggcgaggggtcttgcttgggcttagtctatgagtcatcggctgtgtggcaatgaagagccatctgctgggtggccaccacttccaggaggggccaggctaccctccatccctgtgcccccagctaccagccagaggaggctccgttttgagggtagcttactcaagggtgttccttgctctggcctcagtttccccacccttacactgaggacatttggaggagtctcacgctggtcactgtgccatgtggccttgacttccagtcacatactggccaccttcaggctctcagaagctcccttggccagactgaaatttccagatataatgaacatgggggagcctgtgcctgatgtctttttacctcatgtgccctgtgagacaggccagcaggcacagcagatgctcaaaggtagtgccagagcttgcttgtccatggggctttgtggttccagccagcttctcccttccagggtggtgtcctcagggggctctgacccagggtgcagtgactgccacgacatccaggtctgaggcctcctccacctcctctgttgagcccccggtggactctatacaaagacaaggttttactgccccttcttattttttcatccgtaggagagtgtgggctgggagtggggcaggagtgtacaggagattttaaaggttctggacatgaagagcttgctcaatgaatacagtgtgagctctcctgtctcatctccctagaataaaactctttgtcactgatactcgcatcccgggtagggaaaggaaaggcaaagagtatgttgaaaacatctctcactcttttctggcccacgtgggtgatttcagtcactcagccgtttcccaagacatgggaggtccctggtttgcctaggatgcaatgagggagatttaagctcagccctgataaacagcaaagccaaataaaagcaaaaccacccatcatttgttgaatccttaatttgacacaagccctacactaaacacttttaagtgcgttactttaataaacctgtggtattggcattattgcacacattttacagaaaaggaggctaggctc

SEQ ID NO: 464650 - DNA, 390 bp, Homo sapiens
ccgcacccgggccctcgggcaggactcgtcgccgcccggacgcgcccgccccggaccccgagcgcatccagcgcctccgccgtctcatggtggccaaagaggaaggggacggggccgcaggagcgggccggaggggtccgggtcggagcaggaaggcgccacgcaacgtgctcacgcgaatgccctgtgagtccgcgggccgggcgggaagcggggcagccgccgtccggaagctggctgccgagggggcgtctgcggggcggcggtggccgggcgcgggtctgcacgtattgcgggagcgccttggtgaaaatttgcggggatcatcagtgactatggggtggatctgcttgagtaatgtgggtaatgagggcgtggggagggtcaccc

SEQ ID NO: 464651 - DNA, 1272 bp, Homo sapiens
cgtggcggagtacgagagcttcctcaggaccggagtccggggcggcgggcgcgggcgcgggcgggctcggggcgcggccgcgggctctggggttcccgccgcacccgggccctcgggcaggactcgtcgccgcccggacgcgcccgccccggaccccgagcgcatccagcgcctccgccgtctcatggtggccaaagaggaaggggacggggccgcaggagcgggccggaggggtccgggtcggagcaggaaggcgccacgcaacgtgctcacgcgaatgcccttgcacgaaggcagccctctgggtgaactccatcgctgtatccgtgagggggtgaaggtgaatgttcacatccgcactttcaagggacttcggggcgtctgtacaggcttccttgttgcattcgacaagttctggaatatggcacttactgatgtggatgagacctaccgaaaacctgtcctaggcaaagcatatgaacgggattcttcactgactctcactaggctatttgatcggctgaaacttcaagattcctccaagaaggaagcagattctaagtctgcagttgaagattccactctgtctagatactcacagacatccacttggaagttggcttcagtgtggggaagagcagacactggccggggctcacacaagcgttcccgctctgtcccttcttccctgcaggcctctgcaagggaggagtccaggtcagagctgtcagggaggactacacggacagacggctccagtgtgggaggtaccttttccagggctaccaccctttccagaggccagtcccgtaagaaaaagcgaaagcccaaagtggattaccagcaggtattcactcgacacataaatcagattttcattcgaggcgagaatgtcctgctggttcatcttgcacagtgaccagctcagcctgagctttggtttttagaaataaagtgcatgaattgctgctatgctgtatcctagtatcccagtgaaactctgagttggaatgattccctctggtcctgcatatgcagaggacggagcaggctcagccccctggaagatgagctcaaggggaggacaggccttgggagggcaggcggagaattgctgctagtaaggtcagtttgcaatgttcagctttagatatgtgtcgtaatgggagtctgaaaactgtaataaactgtattcatatcctggctgctttgtctctgttgatttaggggggtgggagagaggaggcaggggagtctgttaccaagtgaaga

SEQ ID NO: 464652 - DNA, 705 bp, Homo sapiens
aaacgacaggttcccggcgggctgtgccggggcttcgctgtgtgaccttgggctggcgtctgggctctctgggcccttgtttccgcgagttaaacgtaggggcgggggagtttctctggccctgccgcctgtgacctaaggagccccgtgacctctccgacccgagcccacccccggcccagtctgcgagcagctccgggacaagcactcccggcgaagacatgtaggctctcagagcctgcgtttccctctgtagagcaggcctagttactgtcttcagggtgcacgcgtctccgtccccgacccgcaccctcaccgccggggtaagctgagccaggcccaagcgacagctggggttgtccgtggggctgcaacccaggaggaggccccaacaatagagccccagaggacggagacaatgggcctctctgtcggcccagccgtccccgccatccaaacagaagcagctgacggaggactgccgggctgggatccctgggctccgcgggggcggctgtgtgccagggcggggcacaagggaagcgcacagacgtttgaagaggggcccccgtgtgcctgccatgattgcatgatggcatctgagcctcacaacctaatcctgagaaaggtgccataatcaccccaactttatcttgagggaactgaggttcgggcctggattaaacccaaactcggccacccgcc

SEQ ID NO: 464653 - DNA, 1854 bp, Homo sapiens
gagatcacgctactgcgctccagcctgggcaacaagagcaagactgtcacacaaaaaaagaaaaatacaggcacgcaaaggatattacagaaatgcaccaaacatgaattattggcacagatacaatatttcaaaacactaactaatattagattgagacatcctattacaacattaaaaccatgcccctttcaattcaagtgagcacctctatttccattccaagaccctgtgatttcatacacatttaacacaacggtaacaataacagtaatgctagctagtatttgttatgcccttaatgagtgccaagctcagctaaatatgtaaaacatgttttgtttgttttattggtgaagagatgagttcttaaacaaccagaagatactgcaggttcaaagtcccggaggccagaaggagcttgcattcaaataagaaaatatattttctcaaggaaatataagttgtatttctatgtaactctatgcaccaggagggccctagcaagaaagagaggtctcactccacagggatttctgaaaaaagtttaatgaacaggccatttacctgagatgtggggtccaggagagggagtggtttcctggaaccagtgagaatagctagttatgggccacggggaagcctgagaggaggtttgaggccacacagtcgctgccaaaactaggggtacatggggaaaataccccaaattagctcttctcccagcctctgatgccctgctggcacttcccattggctggatcgaactggaaccccaagatcaaggaatcctctgtgatggcatccatgagggtccactttgtcagggagcaccgagcagggtgggaaaccctgcctcctcctccaaaacactggatttaggaccctgggggctcactcagtgcaaaggggccagccagtccaggttgctaacgtcaggcggaggggcccaccctcaaagtctacagccttgctactgccacaagagggcgctgcagaacaccggcgctgggaagtctgggggaccttcctcctctgccaaggtgactcccgctggcgggaggcccgaacagctctaggaagcttgcagggaggtgtggagggagaggcacgagcgggaaccggggctgcgtgcggcgcttgcgggccagctggagttccgggtgggtgtgggcttggtgggccccgcacttggagcagccagccagccctgctggccccgggcaatgagggacttagcacccgggccagtggctgtggagggtgtactgggtcccccagcagtgccggcccaccggcactgcgctcgatttctcactgagccttagctgccttcccgcagggcagggttcgggacctgcagcccgccatgcctgagcctcccacccactccatgggctcctgtgtggcccgagcctccccgacgagcaccaccccctgctccacagcgcccagtcccatcgaccacccaagggctgaggaatgcgagcgcacggcgcaggactggcaggcagctccacctgcagccccactcagggattgtaaatacaccaatcagcaccctgtgtttagctcgtttgtgaatgcaccaatcgacactctgtatctagctgctctggccattgtccatggctggctccctgcatctcagataaacactgacacccaaagaaggggcccaatgccagggagtggaaacagcccacagagaaggtgggggtggcccctacacatggacccctggcttggccccaaataccatctcataccaggtttgtaggcaagtgaaatggggtctgggggcaagtttaaggacaacgtaaagggataaaatctcagatggaaaatgtttta

SEQ ID NO: 464654 - DNA, 1818 bp, Homo sapiens
aaacgacaggttcccggcgggctgtgccggggcttcgctgtgtgaccttgggctggcgtctgggctctctgggcccttgtttccgcgagttaaacgtaggggcgggggagtttctctggccctgccgcctgtgacctaaggagccccgtgacctctccgacccgagcccacccccggcccagtctgcgagcagctccgggacaagcactcccggcgaagacatgtaggctctcagagcctgcgtttccctctgtagagcaggcctagttactgtcttcagggtgcacgcgtctccgtccccgacccgcaccctcaccgccgggagatgagttcttaaacaaccagaagatactgcaggttcaaagtcccggaggccagaaggagcttgcattcaaataagaaaatatattttctcaaggaaatataagttgtatttctatgtaactctatgcaccaggagggccctagcaagaaagagaggtctcactccacagggatttctgaaaaaagtttaatgaacaggccatttacctgagatgtggggtccaggagagggagtggtttcctggaaccagtgagaatagctagttatgggccacggggaagcctgagaggaggtttgaggccacacagtcgctgccaaaactaggggtacatggggaaaataccccaaattagctcttctcccagcctctgatgccctgctggcacttcccattggctggatcgaactggaaccccaagatcaaggaatcctctgtgatggcatccatgagggtccactttgtcagggagcaccgagcagggtgggaaaccctgcctcctcctccaaaacactggatttaggaccctgggggctcactcagtgcaaaggggccagccagtccaggttgctaacgtcaggcggaggggcccaccctcaaagtctacagccttgctactgccacaagagggcgctgcagaacaccggcgctgggaagtctgggggaccttcctcctctgccaaggtgactcccgctggcgggaggcccgaacagctctaggaagcttgcagggaggtgtggagggagaggcacgagcgggaaccggggctgcgtgcggcgcttgcgggccagctggagttccgggtgggtgtgggcttggtgggccccgcacttggagcagccagccagccctgctggccccgggcaatgagggacttagcacccgggccagtggctgtggagggtgtactgggtcccccagcagtgccggcccaccggcactgcgctcgatttctcactgagccttagctgccttcccgcagggcagggttcgggacctgcagcccgccatgcctgagcctcccacccactccatgggctcctgtgtggcccgagcctccccgacgagcaccaccccctgctccacagcgcccagtcccatcgaccacccaagggctgaggaatgcgagcgcacggcgcaggactggcaggcagctccacctgcagccccactcagggattgtaaatacaccaatcagcaccctgtgtttagctcgtttgtgaatgcaccaatcgacactctgtatctagctgctctggccattgtccatggctggctccctgcatctcagataaacactgacacccaaagaaggggcccaatgccagggagtggaaacagcccacagagaaggtgggggtggcccctacacatggacccctggcttggccccaaataccatctcataccaggtttgtaggcaagtgaaatggggtctgggggcaagtttaaggacaacgtaaagggataaaatctcagatggaaaatgtttta

SEQ ID NO: 464655 - DNA, 1660 bp, Homo sapiens
gtgtcactggcctgactggtccctgggtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagatgcttgggatttgctttacattctaagtggatttggagaagagacaataaagaataagcagtcaattctataatatatttagaaggagaaaagtgccaaggaggaatgaaaaagtagagcaaggcaaatgtggatatatgtttataactgcacaaatgaattctgaagggacgcataagacattggtattggttgcctatggggaatataattgatatgggggagacttggttttccttgtatgctcttctatatggtttaaaaaattatttatgaaaattaaatatatactaaaaaagagggaaattgctgagtttttccttttagctgcactattaactcttttaggaaaaagcagtgatctatcaaatttgcctctgattggccgaaatgggccagaaatggattcacaagggatcctgggaaatgctgtttgcagagatcagctctgtatggttgtcccatacacagcagagcaaaggagagagggggatgattttgaaatcaaacatggacataaactgcattgcactgaaaacttaccacaatatacaatagcaccttcctgtggccagaaaggtggccgccccctcgcccgtcacgcaatgcatgttcgtggggaacctggtgctaaactattcatagatgacctgcttctggagtctttaagagtttataacatcaggaaagatatggacttggaaacttacattattaaaatagactgcagtggatttaattggacaattcaagacatccattttattgtccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgtacaccaatcaaacatagatttggtcttttcacatagtcccatatttcttggaggcttcgttagtttcttttcagtcttttttgtctaatcttgtcttcttgctttatttcattaattagatctccaatcactgatatactttcttctgcatgattgaatcggctactgaagcttgtgtatgcttcacgaagttctc

SEQ ID NO: 464656 - DNA, 1813 bp, Homo sapiens
gtgtcactggcctgactggtccctgggtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagttccgtgatgatggtctaagcaaagacccttcgtcctgttaaagataaattaaaaaaaaaaaaaaaaaaccaaagggaacaaaacttactctgcaaaagtaatatatgatttacctgctgttgtcataagaattccaaatagacaaactcggtatgcttgggatttgctttacattctaagtggatttggagaagagacaataaagaataagcagtcaattctataatatatttagaaggagaaaagtgccaaggaggaatgaaaaagtagagcaaggcaaatgtggatatatgtttataactgcacaaatgaattctgaagggacgcataagacattggtattggttgcctatggggaatataattgatatgggggagacttggttttccttgtatgctcttctatatggtttaaaaaattatttatgaaaattaaatatatactaaaaaagagggaaattgctgagtttttccttttagctgcactattaactcttttaggaaaaagcagtgatctatcaaatttgcctctgattggccgaaatgggccagaaatggattcacaagggatcctgggaaatgctgtttgcagagatcagctctgtatggttgtcccatacacagcagagcaaaggagagagggggatgattttgaaatcaaacatggacataaactgcattgcactgaaaacttaccacaatatacaatagcaccttcctgtggccagaaaggtggccgccccctcgcccgtcacgcaatgcatgttcgtggggaacctggtgctaaactattcatagatgacctgcttctggagtctttaagagtttataacatcaggaaagatatggacttggaaacttacattattaaaatagactgcagtggatttaattggacaattcaagacatccattttattgtccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgtacaccaatcaaacatagatttggtcttttcacatagtcccatatttcttggaggcttcgttagtttcttttcagtcttttttgtctaatcttgtcttcttgctttatttcattaattagatctccaatcactgatatactttcttctgcatgattgaatcggctactgaagcttgtgtatgcttcacgaagttctc

SEQ ID NO: 464657 - DNA, 847 bp, Homo sapiens
gtggttcccatggaaaccttcaccactggtgactccaagctgaacacaggggatggcaaaggcctagtgaagagtccagatgtagacttaaagagctctggaatctcctccaagggttcagccagaagccatctgactggctatgaccagtattggggactttattcttccaaaggcagtctatccaatttttggaccactctgatggtgtcagaggccttctgtagattgagctcaaataactcacttctagttgtcttaggtcaacaatgtgtggccacagagattaagtcaaactcctcttcatatgtggttgtggtatgtgcccaggctggtcttgagttcctgagctcaagcagtcctccctccttggcctcccaaagtgctgggattacaggcgtgagccaccatgctcagtacttgagatatctgaggcaacactggggattctcctgtaccctgctccagttgattagtctacacacccagagatgtcaagcatcatttcactgtgataccaaccaggtacccaaaggtggagtaccaccttctacggtggagcccataggaagtacataggaagtactagttacttcctaagtaactagttgagtgtcccatgggtctttaatcccctcattcagaacagaaattgcaatgtgagatggaataaaatttctgttggaaacagaaacctaaacacatattatgttcaggtttaactcaaacccacatgtatttggttgcttaaaattttcatctgttaagccatgttttccaatcctttccctttgcatttgtttggaactatatataaatttttaatctgcattcctgcctatttaaa

SEQ ID NO: 464658 - DNA, 3062 bp, Homo sapiens
tacaacagagactgacaaataaaggccatttctcaggacaaatttggccgctgcctgtttttgtaataaagttttatcggaagtcctgccatttagtttttttacatatcgtctgtggttactttcatagtatcatggcagaggttattattacaccagccatattttcatcattttggatgtcttttttaggaattgcatgagtgtgtacatgcatataactaggtacaatgccaacacactgaagatcctgaacactcaggctttggctcccccacctacattccaccatattgaagggcttacctgtctggtgccagcaaagtggaaacattcgcatgctacaattggagaatgtgattctgccagctggtcatattggggctgtgtcctgacctatggacctcatgagaactgcaatccaagcaaatgtggtgggtgtgaagctttcaagaagttgggtcaagaacaaggactgaaagaggagcatcaatttatgggggccactgaggctttcagagattttgtgacctaccaaactggcacagctagtaaatggatgacaagtgtaaagaatactacatgtgaagtcatggagtcgatctgctagttatttttttttttgtcctaattcacatgaaaatagttggaggactgttaacatataatctaaactatctaacaggacctcatataacactcatgaatactatgcttgggaaacaaaagcttattctactcattttgtaaaatgaattttattgtgtatattgaaggaacaacatgatatgggatacaaacacatagtaaaaaagataccacagtgaagcaaattaacatagccatcatctcataagtatccatttttccttgattttttttttttttttttttttttttttggtggcaagagcagctgaaatctactcctgtagcatgaatcccaaatatagcacagttttcttacccatagtcttccggttgtacattaggtctccagacctggccaccctccctacttaatacagacctccatctcccatctcctccctagctatcccctgcctggtaatcactgttttgttctctatttctgtacagttgggtttttgtttgtttgtttgtttttagattccacatatacttgaaacaatgcaatctttttctttctttgtctggtttatttcacttaacacagtgcactccaggctcgtctatgttgtggcaaaggcaagatcttttttagggctgaataatattccaatctagacatataccacagtgtattcatttgtctgtcaccggacacttaggttgttgcctatgttcactgtcacaacgctgcagtgaacacaggcatgcaggtctctttatgaggcggtgatttcatttcctttgggtatgtgcccagaagagagattgttaggtcatctggtaattttatttttaatttccttaggaatatccatactattttacataacagctggaccaatctacattcccagcaacaatgtacaagggttctcttttcttcataccctcaccaacatttgttatcttgtgacttgatagttgccatccaaatgggtgtaaggtggtatctcatctggttttgattaataattaattaatgatgaatgatgttgagcaccttttcatatacctgtgggccatttttgcatattctctgtagaaatgcctattcaggtcttttgcccatttttaaattgggttatgtggtttttccactattgtatgatttttttttttttttttttttgagatggagtctcactctgtcaccaggctggagtgcatgagactgcatctggaaaaaaaaaaaaaaaaaaaagaattacctcatttactcttcacaacaagactacaaagtgagtaccacgataatctatttccaagatgaggcatctgaggcccagagaggtacagtcacttgcccaaggtcacacagtactaagtagtaaatctggaatgagaggctccttgaaagcaatcctaaatttctatcctttcttgatggttttctacttgaaacagttaatatcgtagagtcttgaatcctgttacatcaactccagcatctcctttctctgagcctttttattagacttctttccccatccctaattttacagacgagcacattttattgatgtgaaaatgaagacttataaagactgtcctatttcccaggtcatataaccaactccatgtgtggtcctgtgaaagtgccctaacttctttcaaatatgttttttctcatttgagttgcaaaaataaacccatctgctttgtagccattaacatggaaagaagaagaggcatccaaagtgttgggtccgcatcgcccttgccttggaggaagctccaaatagagggaaggatggtttccagcagtccctgaagtgcctttcctccttcgtgggatccagttacacccagcagacttcagtttgaataaacagaactagatgaatacacctagggaatctgtgaggccagcctcagcttttaacatccagctacagggaggctctcgctcaccgggagattaacccgccaggctgctgagtgagaggggacagagtaggccctgacgggaggcctgggacgcaggggaaatcaaaacaagtccacctgcttaaggagactgccgcactgtgacctcgtcctccggacatctgtggcaagtgttaccgcagccactgatgtggcgcactgggccatttacagctgcctcatgatattctttttcacgactgtgtttacactattgtttaacaactttgtataacaatctcttttcactccaaataaaccttagtgcctggaaggccaagagtatcttcagtatgtgtctatcctagtaagcttctcaaatgatacagaatttttcgttttttttaaaaatttccaacctctcatgtgccaatacttttgtataatcaaaatgattagaaaaatgaacatggactaggatgccttagtagtgtcaaatgactataaatgtgtctaaatgcttaatgtaaatttcttgtcat

SEQ ID NO: 464659 - DNA, 1064 bp, Homo sapiens
aggactgaaaggcagggactaaggtgacagctgactctgccggggcggagtgcgtgtcctcccaccgtgctggcgctgaactgactgtccgctgccaagggaagtgacagccgcagccgggctctcagccagcggccaggcgccccgcggaccatgctctccagtacgcagaacgcgggcggctcctatcagcgggtccgcggggcgcttgatacacagaaatgcagtccagagaaaagtgcctcatttttcagtaaagtgacatattcctggtttagcagagtaattacttttaggctataagagacctttggaaagagaggatcttttttgaactaaaggaaagtgattccttctgcactgcgtgtcccatctttgaaaaacaatggagaaaggaagttttaaggaatcaagagaggcaaaaagtaaaggtatcttgttataaagaggcacatatcaagaaaccatctctactctatgcattgtggaacacctttaaatccatcctgattcaagttgccttattcaaagtgtttgctgatattttgtccttcactagcccactcataatgaattataccagaaaagttaattatttgatgggcctgccatgtgaaaaccagaaaataacctcgtactcacaagccagtggaagggattcctgattttactaaaaaaaaaaaaaaaaaagagagggcggggacaaatatcaaattaagcaagtaaagaaaaagaacaggcaaattatcattttctgtgaacacagctcagattttggctggaatggctatggctatgcagtggcacttcttgttgtagtctttttgcaaactctgattcttcagcaatatcaacgttttaacatgctcacctcagcaaaagttaagacagctgtaaatggactgatctacaaaaagaaatgtaaaggcttatttggcagaaaaaaatattgaagaaaaaaaacccaaaaatttgaaaaaattcccctagtgttagaaatgccatacaaacaaccttcaattatataatacctttcagtattttctctaatagtctaaaagcaa

SEQ ID NO: 464660 - DNA, 1362 bp, Homo sapiens
ccaccatactcagttggtcaaagcagtcacaggatcaaactgcatcacggaagctgcacacgatgacaccctgtctggaaagtttttgccagagggcaaaagactgcaagcagaatatccctttgccatttctcattcaggactggccgttgtctgaaagcaaacctcaaggacaggacttctggactccgcagccacttcaggctgctgctccatcgcatgaattccagcaggtggcgctgcaccccgcgcggacccggcttgcctctcggccccagggaggtcggttgatgagcagtcgggaagtgggtctgcgcgcaccccgctgcagctgtggcaaacgcaaacgatgacacacaggcttgacgagggcctttgtcagaagcaatggggatctggcgtcaccgcacaatggaaaacaaagtgcttctgcctggctggccagaatgcacgtttgctcactattgatgctggggcatttacaggcagaatgagttcatgtgaaatttcaggatctgccatgactcagattcactttctgtaaaccagagtcaacattacatttccctttactctgggccattccttgaatttttaggtcaccagttgtttttgtactaactgaagggatttgagtatttcacaagcaccttatttttattagcatttttagggcattaccaatttgggacggatctgtagtgtctattgcattttaatatccgccgaataggtagcatgaattcacatcatttcagcgatggggaaatggaaactcgcagagagcttaactgaatttcctgagaccatgggatgtcagaagggccactaaatctttcaacttccaactcatactttaaactcctgcctcttatcctttttgaagtgactggggaagaccaggtacagatctgtaaaatgcttcattccattttcagaggagctgaggtcaggtgcttcctacagtcgaggtctcgccaagaagacggtggccacgttcctcaattctcaggcgagtgttttgatgcctgggtgcttctgcctgatgagcccagcattcatgaagtacatgtgacaagaggacggctggaatattgctcaatattttcaggccgacggcactggctgcatctgaatctccctaaaccccacgtctgcggcaaagtcttcgtggtgaaacaggtgagtcacacttttctgcttctctgcaattacaaatgttatcacctcatctgacacagagagggtgttggttggaaatacgcattaggaataagctctttggaaacagcaaaactgccttcatgaaatgaagacttttttttagaaagtctggagctaaagttataaaaataaagaggc

SEQ ID NO: 464661 - DNA, 1767 bp, Homo sapiens
  misc_feature (1607)..(1607): n is a, c, g, or t
  misc_feature (1613)..(1613): n is a, c, g, or t
  misc_feature (1621)..(1621): n is a, c, g, or t
  misc_feature (1624)..(1624): n is a, c, g, or t
  misc_feature (1628)..(1628): n is a, c, g, or t
  misc_feature (1630)..(1630): n is a, c, g, or t
  misc_feature (1632)..(1634): n is a, c, g, or t
  misc_feature (1640)..(1640): n is a, c, g, or t
  misc_feature (1650)..(1651): n is a, c, g, or t
  misc_feature (1653)..(1654): n is a, c, g, or t
  misc_feature (1663)..(1663): n is a, c, g, or t
  misc_feature (1673)..(1673): n is a, c, g, or t
  misc_feature (1678)..(1678): n is a, c, g, or t
  misc_feature (1683)..(1683): n is a, c, g, or t
  misc_feature (1699)..(1699): n is a, c, g, or t
  misc_feature (1704)..(1704): n is a, c, g, or t
  misc_feature (1765)..(1765): n is a, c, g, or t
gttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagtttgagaaagaaagatcttggggctgggctaatgtttgggtgtttatgcagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggcaggcctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccagttagcgnaaaaancggggagnttnccgnancnnnaaacancggggcaaannanngccctcacncatgtatggngagancacgncgcctactcgcatgcngggancagtagagcgagtgcccacaatagtatgaatttgaacgatctcctactagcgccaatccantg

SEQ ID NO: 464662 - DNA, 2797 bp, Homo sapiens
gaaggagttgctgagaaggagctgtggttctgaccttcaggggaattcccacgtctgtatggtggctcgtgaagagcatggttccttttctcagccctcttgaggggcgaggatgctgaggactgaagtcggtggggcttgatgcatgtggtcactgagaggctgccagagggccattttcatgaccagagggatctgttcaacaccctgtgggtcccagcacctatctcaggaagcagggtgcatctgtccaccaccaagtctcagggtggctgggtgagcgctcatcagtcccagacagcaggttggcacaaaacgacactgcccacaaaaccacaggaagaagagaaactccgactgtctttcagcacacagaagacactgtactggacccggacattaggcagacacccacgcctgactttcaggagaaaagagaacatgactaacggatattcttagtagatggtttattagaaaagagaacatcttccagcatgtgtcctggggtgatgggtgtgggaagcactcagtccatagtcctggtccctggcttccccaagcccagcaccatgaatgtacagtggaaagcagagggtgcagcgtctcagaaagatgcttccactcacaaggattggagctcacaagtgagctccataacctgcaaaccagagaaacctgagacactgccccttggccattttatcaacggagactttattgtgattatcccggcagggggccgagctctcctctctgcaacaggaaatgctctttagtgaaaatgcagcatttctccaagggtaacaaagctgaacgcctgcttagcttatgaaccctcagttggcctaggtggtgcaaagaccctgctgttactgctttgatcatcagtactgtggactgtaccaggagatccctgggaatgtgctctgggcggaagcagcttttatctttggccctcacccatgctttatatggtgaggttgggaaaatggcacaaggcttctcctgaacctcaaatcaacacccttgccccatttagatcctatctggctgtttcttgctaatattactgcatcactgcaccatctttcctatttcagcaaagtggagtcatgtgtggtttatggggtagatggaccccaaaactgataatatgaatcaagctatggtgtttactccctaggaaatgcacaatttttctggaaacctacagaagcttcaaatgcattcgccatgcaaagctaagtcagcagaacaacccgtttggctttggaggctagttcagttccgcggacagggagaaagatgaggcagactgtggtttttcagttcctggagcttacggagctccaaagctccctctcttcccaccctggctgcactgttcttaattttagataataccctgccttctcgtattgctgctgagctcctagcatcctcagtttatctgtctgtgaaatgaaaaatctaatgttaaattttttacctatggcatgagagagatggctatggctcttgtgagcctctctgcagcccctcttttccttcaatcaccctctgtctctcctgccttctgcttattctctctctcccctcatccccactttcccagtgggtcctctgttctcttttttttttttctttttaaatctctctatgcctccagccgagaagataaagagtgtacatctttctggttaaaaagttttgctttgcagaaacacagccaatttatgattctggccttcccagctagggacagtgttcatttacatttaggaccatgaggagagaggcttagctgtgtgtttctgaggccggagaaaattacagtgatatataacagtgctgcactcatagaggtgctgagccggggttgggctcaggcggccgctaagctcagagtggaaagtttcagaggggaggcagaaaggagaggtctatagctcctccagattctaggtattaatttactaagatattcctaagccagaaaacagagacagaagacaaagagaaagagggaagaagagcaagacagagagttagagagagacaaagagagagagttagagacaaagagagagtggagaggagagagagcaaatattgaaaggaaaaggaaaaagaaagaaacctgacagctcatgaactttttaaaaagttacaaattagatttgaagagatgggcagaggtgaatccactgttgtgtgaacatcacagagtgcacgtatgcacacctagatggcatattcgacaacacacctgggctctctggtacagcctgttgctcctgcgctacaaacctgcacagcatgggactgtcctgaatactgcagatggctgtaacacaacgcagagcctggctcccctccgccaccatgagcggctgctccaaaagatgcaaaagcttgggttcgtgaaatttgcccagaccatctttaagctcatcactgggaccctcagcaaagcagtgaccagccagaacgacctggatgagacaagggtcagtgcaaacaagaccaaaggcctgttcctgcccccattccgctctcatgctctgctgggggactgcccctgggtgcaggcccacactgcctatgcatcacagctggccaggtgctcagacgggggaccggcctgcttggagtcacacagccagcatgaagcatagccacaactggaagcctaggcggtctggccccaagccctgggttttacttccctccccagcccatccccagtacactctttccatttctgaaaatcagatccagggtaagaagcaac

SEQ ID NO: 464663 - DNA, 576 bp, Homo sapiens
acatcacactctggggcctgttgtggggttgctaacgtccagacacataggctgcggtgtctgctgctactctccgagcttcgcaatgccgcccaaggacgacgagaagaaggacgctggaaagtcagccaagaaagacaaagacccagtgaacaaatccgggggcaaggccaaaaagaagaagtggtccaaaggcaaagttcgggacaagctcaataacttagtcttgtttgacaaagctacctatgacaaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctgaacactgggctaaaaatcagggtacacaggaggtggagaggagatgtgtgaggcgagagcagcccgcagcgagcagtggggaggagggaaagctctatcagcctgggcggcagagctcctccctgtgagg

SEQ ID NO: 464664 - DNA, 459 bp, Homo sapiens
acatcacactctggggcctgttgtggggttgctaacgtccagacacataggctgcggtgtctgctgctactctccgagcttcgcaatgccgcccaaggacgacgagaagaaggacgctggaaagtcagccaagaaagacaaagacccagtgaacaaatccgggggcaaggccaaaaagaagaagtggtccaaaggcaaagttcgggacaagctcaataacttagtcttgtttgacaaagctacctatgacaaactctgtaaggaagttcccaactataaacttataaccccagctgtggtctctgagagactgaagattcgaggctccctggccagggcagcccttcaggagctccttagtaaaggacttatcaaactggtttcaaagcacagagcacacagtgagcacacaggatagggagtggagcacactaggtggggattggggtacgcgagctc

SEQ ID NO: 464665 - DNA, 509 bp, Homo sapiens
acatcacactctggggcctgttgtggggttgctaacgtccagacacataggctgcggtgtctgctgctactctccgagcttcgcaatgccgcccaaggacgacgagaagaaggacgctggaaagtcagccaagaaagacaaagacccagtgaacaaatccgggggcaaggccaaaaagaagaagtggtccaaaggcaaagttcgggacaagctcaataacttagtcttgtttgacaaagctacctatgacaaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatca

SEQ ID NO: 464666 - DNA, 3807 bp, Homo sapiens
  misc_feature (3802)..(3802): n is a, c, g, or t
tgtcagaggctgcctggcagtggggacatgagcctttcccttagagggaaacatgagattgggcaacaagggggtgagcacattgcaaatgttccgccggcgaatcagcacctgcctggaggtgttcttggtgtctgcgtcctgcctccagtacagaggacctcaaatccatgatacttcacctggtgctccccaggaaagcctggcagaggacctgacgattcccagcaagaccaagcactgctgtccagggtcagccacggtcacttctctgcagctgtcatccgggcacaatctccaaatatttctagccattcagacgttcactataatcagaattaacgcatgtagaaccaaagagccagacacatgggttcaaacctgccccaccatttacagtgagagcttaacctgccagtccagggcactaaatcacaagaacaccaaggccaaacaggcttgaagtctccaggctcctcactggcaaactctacttcctgatcccttagtgggttgaggtgccaacagccccctggggaggagggggttgcattatggccgtggagagactctgagccttatcaacggtgtggggatgacacccttttcggagcactttgtgaggctttgtgccatgctgggcgcttggcgtcagagacaaatagaatcaataactgtgcaaaaaaagttgccagataatttatcccattggcaccgagcctagaattataatcagatcttgacttcttcaaagccttcttgctttggattttccaaatcgaaaataaatattgggggcaattacctttccttagttctctgatgtatgaaggggagttttcatctattaatttaagaaccctctcatttcattcggaaggtattagcccatggaacttgttaacttaatatcaacacagtctgtctaggttttgactgaaaagagaaaggggttgttatgctctaggttaatattttcctctctttaagaagtcttgggtatgccagacacttctcggacaaaaacagctgttttcttcccattgctgaacgcattgtttgtgcgagttcacttacttgctatactcagaatatcctccaggagtcagcaaatcccaacctctggacgtggctcagggccgccctgcccattgctgagctgatttggaatttgggcctgagagaggaagtgattattggatgacaggctgcctcctagggggcttctctgggcttgccatgaaagcacttccggaggaaaagcagagctccatcagtctcttttggagagctgtgaacgtgaccagacctattaattacttaactgaggtgctgaactttgaaaatgaaagttccggtggggagttctgtcctttccagcctggggagctctgtcagggctctcctgagcgtctctttcagcttatcaagctcgctcggggaccgtctctgccgccatgtaggaagtgcctttagccttctgccatgattgtgaggcctccccagccatgtgcaactactgggaaagtgaggtgcagaggtattttgcaacgtgcccacagaaccccagcgagcccgtgttggagttacaactgtgcctcagggagcattctcaggcagcattctcttatgcttcaccgtctcacagatgataaggtttcattcaaggacttacaacagcaacccggagggagcattctcagtggctggtagatgccatttgtactgagcaggacaattaagcccaattctggaaaaattctgctttctctattcaatgcattttataaatgtcttcactcagcacatttaccctactaattatattttgctttgtgatcatggtatgtcatttgcattccttcagcacacactgactgatggggaagagatgttgggtgacccaggcaagccaaacaggattaaagcctgctgtctcaccaggtggataatccactttgaacacttgagaggggagtgttgagatcacaccccttcccatgggacatttttctgggaaataaaatcggtgacaaacaccacgcttgaacactcacattgactctagggtgcaggctgagctcatctggtgcaggggagtaatgcagaggcgaggcctgagtcagcgccaggcacaggaaggggatgcaggatgcaccacagcccatgcctcttaggagaaaatctgggccttctccatggctgtgtctctattaatttgctaaggctgcccaaataaagcaccacacatgggcagcttacataacaggaatttattctcagttctggaggccggcagtctgagatcaaggtgtcagcacagctggttccttctgaggactgtgcaggagaatctgttccaggcctctccctgaacttctgggggtcactggccatatttggcattccttggcttatagaagcaataccccaatttctgccttcatccgcatgtggcattctccctgtgtgcgtgtttctgtgtccacatttttcctttttataaggataccagtcatgttggaggtctaccctactccttgatgaccttatcttaactagttatatctgcaacaaacctatttccaaattaggtcacattctgaggtcctgggggttaggactttaacatatgaattttaagaggacacagtccaacccataatagtaactttgtccctctctctcttttgacacaataatgaccctatgcagggatatttctaggtggctactgtctgtgtgtgtgtggtagggggacttctagtactgttttggattactgttgacagacagcagcctgaggctaggaagcactttggggccatgacttagagcaaagctagtaagttttctcaggaatttgaacccagaatttcatccccatggcactttaatccagtacatttaatggctcagatgaccctggccttatcagcctggtgctctaagcagctgacctaacagtgtgtgcatgcgtgtatgcacatgtgtatgttatgtgcatatataagtgcatacacataatgttggacacagaaatatctctgagaactgtccctttatcacccttcagataaaattattctcagcttgcttagttgcagtgtttcttactttgcatctcctaacactttcatacatttctcccgaagtgcataggcaaggagcttcaacggaattcaatgtcaacctggtcatcttaccatgatttctaggaaaaaatgtgtgtaattggttcatgccctccttctgtacagattacaattctccttttttggcatgaaaacctccatctgtcttttgaaagcacatgtcacttatttattaaagtcctccccaacttgttcaggttgagtttcactagtacctttctggagtattttatacctatgttatagccccatatgttatactttggatgtctgtttacctgtctgtaagactgtctgcataattcatgggccttgtacaaaataagaattcagggactcttgttacaagaaactattaagaatttcaagatgggtcaggcgcggtggctcacgcctgtaatcccaacactttgggaggctgaggcgggcagatcacgaggtcaggagttcgagaccagcctggccaacatggcgaaaccctgtctctactaaaaatacaaaaatgagctgggcgtggtggtgtctgcctgtaattccagctactcaggaggctgaggcaggagaatcacttgaacctgggaggtggaggttgcagtgagccaagatcgcacggttgcacttcagcctgggaaatggaatgagactcnatctc

SEQ ID NO: 464667 - DNA, 2441 bp, Homo sapiens
tgtcagaggctgcctggcagtggggacatgagcctttcccttagagggaaacatgagattgggcaacaagggggtgagcacattgcaaatgttccgccggcgaatcagcacctgcctggaggtgttcttggtgtctgcgtcctgcctccagtacagaggacctcaaatccatgatacttcacctggtgctccccaggaaagcctggcagaggacctgacgattcccagcaagaccaagcactgctgtccagggtcagccacggtcacttctctgcagctgtcatccgggcacaatctccaaatatttctagccattcagacgttcactataatcagaattaacgcatgtagaaccaaagagccagacacatgggttcaaacctgccccaccatttacagtgagagcttaacctgccagtccagggcactaaatcacaagaacaccaaggccaaacaggcttgaagtctccaggctcctcactggcaaactctacttcctgatcccttagtgggttgaggtgccaacagccccctggggaggagggggttgcattatggccgtggagagactctgagccttatcaacggtgtggggatgacacccttttcggagcactttgtgaggctttgtgccatgctgggcgcttggcgtcagagacaaatagaatcaataactgtgcaaaaaaagttgccagataatttatcccattggcaccgagcctagaattataatcagatcttgacttcttcaaagccttcttgctttggattttccaaatcgaaaataaatattgggggcaattacctttccttagttctctgatgtatgaaggggagttttcatctattaatttaagaaccctctcatttcattcggaaggtattagcccatggaacttgttaacttaatatcaacacagtctgtctaggttttgactgaaaagagaaaggggttgttatgctctaggttaatattttcctctctttaagaagtcttgggtatgccagacacttctcggacaaaaacagctgttttcttcccattgctgaacgcattgtttgtgcgagttcacttacttgctatactcagaatatcctccaggagtcagcaaatcccaacctctggacgtggctcagggccgccctgcccattgctgagctgatttggaatttgggcctgagagaggaagtgattattggatgacaggctgcctcctagggggcttctctgggcttgccatgaaagcacttccggaggaaaagcagagctccatcagtctcttttggagagctgtgaacgtgaccagacctattaattacttaactgaggtgctgaactttgaaaatgaaagttccggtggggagttctgtcctttccagcctggggagctctgtcagggctctcctgagcgtctctttcagcttatcaagctcgctcggggaccgtctctgagagagagtctcactctgtcacccaggctggagtgcagtggcatgatctcggctcactgcaacctccgcctcctgggttcaagtgattctcctgccacagccccttgagtagttgacgttacaggcacccaccaccgcacccagatacttttcgtatttttagtggagacgctgtttcaccatgttggccagttggtctcgaactcctgacctcaagtgatctgcctgccttggcctccctatgtgctgggttataggcgtaagccactgtgccctgcttcatgtcatttttaaagagcccacacaactcctgtagctgcattacgacaacctcaacggcaagacctcgacgtgatattactccacgtgaaagtctaaaaggcgctgagcacagtgctctgccaatggtgtgtcttccagcctcgcttgctgagagaacagatgtgccggggaagaaatggacaaagctgggaaaggagtctaacttcttcaaagcggttgggcaccggtgaggctcttttggttacaaaccacagaaatggattctggtttatcagtttaatctcggtgtaactaaaagtgggaagtactggaaggagacgcatttcatgggctcagagctaatgtcccccgatcaaaagtaatctctattctaggctttttcaccttggaacagtcttgcctttttctgaccctcatataagtggaaatgtacaatatctgctgttttgtgtctggcttcttttgccctgtgtgatgtctgtgagattcacctgtgttggtgtgtattggtatttttctcattctcatcgctgggtatacctcactgcatggataaaccattcctctgtggaaagatattttggttgtctcagtgtggggctattatgcacattcttgtaatgtcatttggtagacatgaacacccacatccaaggaatatgtgcctaggagaggaggggttgagtcagattgtatatttagttttc

SEQ ID NO: 464668 - DNA, 2078 bp, Homo sapiens
gcgctatgtctctagcactatacaaagcactgaatatataccatgggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtgaggaacagaaccaagcctccccagcagccgtcccactgccctcagtcctaaagttgaaactgttctgtgttatgtatgtaggggacctcactcacaagtctgtctccccaggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggagtctgcgtgtgtcagtgatgcctagccccgccttccccagcagaccaatgtagggatggaaaagggagaaaaacagtaaacttgtgaccctgaggttcttgtctccagcgtccaccctgcggcttgggagctcctcctcgggaggcagcccccgtacatacgcacccgcgactttgcagctttcacctgaaggtctgagcgaacgccggcggcgcac

SEQ ID NO: 464669 - DNA, 881 bp, Homo sapiens
gcgagggctaattaagctggatttataaataggttatttatttttgtcttgtaaatagaattatagattgaatagagcctctacctcggccaagggtcttcaaactcttttttaaagcaggggaaccttctgttgaatggagctgtgtgcagaaccacagcataaaaatggaagcaaaagttctctggtcaggttggaaaggaaggcctggggtcctgctcaggcctggagggcacccatttccagcggccatctgtccccctgccccagtccctgatgtgttctgtggaacctcagggttccaagggacagagtctgaaagacattgctctaaatgaatctgtgctgcatggaatgtattttccagtcgctgcctccaggattactgaacatggagggggcgctgtggtctcaaatcccaggtgcattagcatttccgttttcatgtaggttgacacagtgttcccttgtactagaaaatgccagtgggtgttagcaaaggccctttacacgcagaacaatgagcccagagcgaggcgcaagcttcaaagccgtctcttcactggaaagggtgacgcggcgcaagatttacccctgaacctctctgggagtgtgagcttcatgggcctcagtaggtaggtgtttgggtcggctcttttcagttccgaaatgaaaatatcctatgggcttatcggaagcctcaggtctgacatttagaggtgtgtcttccttcccaaactgaaaacacacatttcctctccttctcctaagagactgaggaatcccgagatgtcagccaagcgcagaatagccaggtgctcgaggcgctgctgacaggctgctgtgagggtcagggctctgcactctcaggggggctccgg

SEQ ID NO: 464670 - DNA, 935 bp, Homo sapiens
gcgagggctaattaagctggatttataaataggttatttatttttgtcttgtaaatagaattatagattgaatagagcctctacctcggccaagggtcttcaaactcttttttaaagcaggggaaccttctgttgaatggagctgtgtgcagaaccacagcataaaaatggaagcaaaagttctctggtcaggttggaaaggaaggcctggggtcctgctcaggcctggagggcacccatttccagcggccatctgtccccctgccccagtccctgatgtgttctgtggaacctcagggttccaagggacagagtctgaaagacattgctctaaatgaatctgtgctgcatggaatgtattttccagtcgctgcctccaggattactgaacatggagggggcgctgtggtctcaaatcccaggtgcattagcatttccgttttcatgtaggttgacacagtgttcccttgtactagaaaatgccagtgggtgttagcaaaggccctttacacgcagaacaatgagcccagagcgaggcgcaagcttcaaagccgtctcttcactggaaagggtgacgcggcgcaagatttacccctgaacctctctgggagtgtgagcttcatgggcctcagtaggaggagacggtggagaagaaaaagactttaccaggctgtctgcagacacccttgtcctagaggccctggagtgggacagctgggtggctcctcggaagactccacaaccccttggtactcaatgattaagtgatgaaagaaagtgcttttaattgtgttcgttggtatgaggggaaaaacccaaaaccttgggtaatctactgtcagaaaactgagaatcatcagtatcaagaaggttcttctcctgaaaggagccccttgacacatttgcaaaataaacggttttcattggtcagacga

SEQ ID NO: 464671 - DNA, 295 bp, Homo sapiens
agcagaagaatgttcacaaaggagctgtttaaggctggtctacaaagggggtagtgtggagtagaacagggaagaattagccacttagatcatccaacaggatggacatgccaaaagtcactttgattctgccaccaaattaagaacatgattttaataaacgattacatttagtatctattcctcattgtaataccttagtcatgcttgcacaagctaattctaaatctagtttgtcttccccaggtactcaatgattaagtgatgaaagaaagtgcttttaattgtgttcgtt

SEQ ID NO: 464672 - DNA, 1804 bp, Homo sapiens
gcgagggctaattaagctggatttataaataggttatttatttttgtcttgtaaatagaattatagattgaatagagcctctacctcggccaagggtcttcaaactcttttttaaagcaggggaaccttctgttgaatggagctgtgtgcagaaccacagcataaaaatggaagcaaaagttctctggtcaggttggaaaggaaggcctggggtcctgctcaggcctggagggcacccatttccagcggccatctgtccccctgccccagtccctgatgtgttctgtggaacctcagggttccaagggacagagtctgaaagacattgctctaaatgaatctgtgctgcatggaatgtattttccagtcgctgcctccaggattactgaacatggagggggcgctgtggtctcaaatcccaggtgcattagcatttccgttttcatgtaggttgacacagtgttcccttgtactagaaaatgccagtgggtgttagcaaaggccctttacacgcagaacaatgagcccagagcgaggcgcaagcttcaaagccgtctcttcactggaaagggtgacgcggcgcaagatttacccctgaacctctctgggagtgtgagcttcatgggcctcagtaggaggagacggtggagaagaaaaagactttaccaggctgtctgcagacacccttgtcctagaggccctggagtgggacagctgggtggctcctcggaagactccacaaccccttggtactcaatgattaagtgatgaaagaaagtgcttttaattgtgttcgttggtatgaggggaaaaacccaaaaccttgggtaatctactgtcagaaaactgagaatcatcagtatcaagaaggttcttctcctgaaaggagccccttgacacatttgcaaaataaacggttttcattggtcagacgaaaacagtttccaaggattgggaacttgtggtctccgatggcagcttcccctgctccctctgcttccctgtctcctttctggcgtaattgctcacctggcaaaccagcaccaagctgggaccccaaccctgcacacagcccaactcctcagtggcaaggccagcagccttggacatctgggcctctgttctcatacaaagcttcagcaccatgtttgatttccctgagaaggttggcaattgtggccaattcccaaagcactggtattctttctggttcctcttgaccaaccaggaggcacacagcccaagtccctgcctcacactgtcaaagccgaggaatgtggacagaggatatgcagccacgggactcacaaaggcagccctggcttcaccatggagggccggccctggggctgcaggtacagagtggacgcccacctgggagcttttgcacgggaagacccatgcaaaagtggacctgctggactgctcagtcattcctcttgagctcgatggccttgtggctcatggcttggaaaattaccttcacacaaacagcaacagaaagaaagatacacggctgacagttattagagctctgagcatacagtaagcatctgataaatactgatgggctggctattcaattacaactgacccgacaacctattcttgaagcattatttaatttatactagatgttcttttttggggttttcagttctaaaatctctctcaaataacttttcctgccaagcggttatttgagttgcgtcggaaagctttcttagtgaattctgcactgaatggctcccctggaagaagtttattactttgtcatcttatttgttaggaaagttgtgatatg

SEQ ID NO: 464673 - DNA, 2472 bp, Homo sapiens
agccacagaactcggccgagggttcagcggactgcggctgcgcggcgccggcgacagcgtcaactgcttttgtgtcaaaaggaaaccaacagccggctccatagctcagggggggagacgatggcactaccgcgccccttcccgccatgcgtttgtttgcggcgttccccgacgcgcgcgctgaggctctggtctgcggctctgcgcttggcggctgcgcgccctcggccttcgggtccccgccgcctccgtgctgcaaggtctgatttcttcctgtggagttaacacggaaaagcgcagacggccacattcatgacccgggagtaacggctctacctgtcacattcgctttcagcctaaaacaaaattttagtttattttagacaaaatatataactaaggtatgctggccttctgactgatttattcttgctgttaacggaagtgtagaaagtgagcccaagtcctcagtgaacagtgggggcgctgcccaggtgcaggactggccccctgggggtctcgggacggctcccgcctccgtcttccccgcaccgcgcactttggaggcctgggcacaggtggaggcggcgctgggtcccgccgtacactcccctgtcgcaggcgccctctctccagccggagggaacctcaaaaaagctctgagcgagtccccgtcccaggtggggccgcggcttataccgggaccactccagggtagctcaaggttcgaaaacggaatccctgtccggtgaaccagagaagagaaaatcgctcggggccacctgggtagagaccggaggggtgactgccttgactgggaggcgtggaggagcgagcggggtctgcggctccggccgggaggtatgcgcttccctctctcacccatgcctgctccggtccaaagagccgagaccgtgggtcaagaccgggatggattcgctcgggagaggccaggagcctgccagcacgttcgggcactagcgctcccggggctcctcggactcgtggaccccgaaacgcctgccccacaggaagatcaccccactgtagaagtcgggtcacggggaccagtggcgagctacctgacggcttaactacagataccctcccgacgaaagccgtggactcccagggtgcgtgcgtctgcttgtgtgtgggggtgttggcaggcggtccccataatcatcgaagagacaggtggatgaacctcaggcctcgcactcgggggctctcagagtctgggcgttacagccgctcccgtacactcacgggtcacctggctgaatcaggtgggatctgggtgaggtgccgggaggtctcccaggctggcgctcctgtccagctgctgggggaggcgtgggtgcgaggcttgggacaagggagagctatgccgggtggggaggacccttggggcgggtccgttcacctgaaatgttcactgctggaagagccgaaagccagccacggcacccaggggagtccagcgtggagaggcagagaggaggggcgaggacagtggcggtcgcagacggcggagcaagatcgccgagcgtgcgaatggaaaaatgagcattgtttcctcggagtagcttaaccaccatcccacgctgttttacagcagtgtaggaaatgtctctgctggtgacacaaaaataaacctgtgcatcagctctgagtagattatcgcgaattttacagcaggaaaccgcatcactatttttactactaaataaaccagtgcaattaaagtgcgcagggcgagagtaggtctgaggcgagaaaagaggagcgcgcccgcccagctcgagcctcaggcttgccctgtgctggaggcggcccgggggcaatcccgggagaatgctgcgagggctgtgagccaggaccccgactctgcaccgcgggagcgcgcgcgcgtgggtcccagcctccgagctgtgcaacaaccccgtggctagagtctccacgagaagacagagttcctggtcatcggtcgtttccgccttacactttcctacatttcctgaagattttgcaaatgggtatgcactgtttattatcttttcataaaacggtaagagcggcttctgggggctcctcacccagccggtccggcgttccttccctctcagcactgcgctctctcccgagccctccggctctaccaacctctgtgtcctgcccctgggcctcaagatttgcgcctttcttggactcgcttgggaaggggcgcccaggctgcagaacggatggacgctcctgcctgctactcgagtggatcgagcagggaggcgctcattcggattccaggagaccagaggacacaggacatagggagcgtttaccctgtgtggagctacctgcggctgagaattagtggcagacgcggagatgggcagcggggacaagttgggcttgggagactataagaccttgagaatgggttcaagctgccagacggaaatccgccttttc

SEQ ID NO: 464674 - DNA, 731 bp, Homo sapiens
gcagtcaccaccgcgaacgcagccgcctctccttagtcgccgccatgacgaccgcgtccacctcacaggccgccatcaaccgccagatcaacctggagctctacgcctcctgcgtttacctgtccatgtcttactactttgaccgcgatgatgtggctttgaagaactttgccaaatactttcttcaccaatctcatgaggagagggaacatgctgagaaactgatgaagctgcagaaccaaggaggtggccgaatcttccttcaggatatcaagaaaccggactgtgatgactgggagagcgggctgaatgcgatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 464675 - DNA, 1561 bp, Homo sapiens
tttttttttttttttttttttttgagacggatttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttggtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggagatcagtgtggaaatggatgtggacgcggtgctgctgcctgagattagcaggaagcaattcttttcccatttggagagaccccgatattacctatattgccttgatctgctgtctgaaggctttgttgggccaggagatggttttgcagcagcagaagactatgaactgggctttgggagataggatctctggttgtattctggctatccacactctgaaagaggaccgtgacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaa

SEQ ID NO: 464676 - DNA, 947 bp, Homo sapiens
gttgaagatgactcactaccaccacgtccaacctccaatttgaaggaaaatggaaaggggaaagttgaaccaacagtacctttatgaaggcatggcctgaaaatggaagattatcacttctctttgcatcacactggcagatcagtgtggaaatggatgtggacgcggtgctgctgcctgagattagcaggaagcaattcttttcccatttggagagaccccgatattacctatattgccttgatctgctgtctgaaggctttgttgggccaggagatggttttgcagcagcagaagactatgaactgggctttgggagataggatctctggttgtattctggctatccacactctgaaagaggaccgtgacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaa

SEQ ID NO: 464677 - DNA, 556 bp, Homo sapiens
gagctgtacaaagtagttgccaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttt

SEQ ID NO: 464678 - DNA, 891 bp, Homo sapiens
gggagagggaagcgctcgtgcccaccttgctcgcaggtgcccttgctgacctgggtgatggccttctccccgcggctctcggccctctggctggcggcgcgcagctggcagccgctcggatcagtgtggaaatggatgtggacgcggtgctgctgcctgagattagcaggaagcaattcttttcccatttggagagaccccggctttgttgggccaggagatggttttgcagcagcagaagactatgaactgggctttgggagataggatctctggttgtattctggctatccacactctgaaagaggaccgtgacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaa

SEQ ID NO: 464679 - DNA, 3726 bp, Homo sapiens
  misc_feature (3)..(3): n is a, c, g, or t
  misc_feature (5)..(6): n is a, c, g, or t
ccncnnagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagtcctatcggggcctcctctctgtggtgcagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtataccaacgaccgcccacgctgcctttggctgcccgtgtcttttt

SEQ ID NO: 464680 - DNA, 2802 bp, Homo sapiens
  misc_feature (92)..(92): n is a, c, g, or t
gcgtggttcttgcagaaccagcacctcggatgccctccagggctcgaagagagtgtactgcgtgggacagcctccctgggcagttcagctancccagttccgtgcctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacca

SEQ ID NO: 464681 - DNA, 1610 bp, Homo sapiens
  misc_feature (31)..(32): n is a, c, g, or t
aaactacggctaggtagcaggcctgggtggnnccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacca

SEQ ID NO: 464682 - DNA, 3575 bp, Homo sapiens
  misc_feature (3)..(3): n is a, c, g, or t
  misc_feature (5)..(6): n is a, c, g, or t
ccncnnagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagtcctatcggggcctcctctctgtggtgcagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacca

SEQ ID NO: 464683 - DNA, 2423 bp, Homo sapiens
  misc_feature (3)..(3): n is a, c, g, or t
  misc_feature (5)..(6): n is a, c, g, or t
ccncnnagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagtcctatcggggcctcctctctgtggtgcagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagtcctttccttttgccctagtgcctcctcttgctgatgtagtctcctctttcgtcttatgatcacacgagtctacactggctacatcaccctatccctctctcatccttgtcggcctctacacactttaaccgccttcctacttgcgatcgtaaatgctttcctgattggttaaatgccttaggtctgttgcatcctcttaatcacg

SEQ ID NO: 464684 - DNA, 3687 bp, Homo sapiens
  misc_feature (3)..(3): n is a, c, g, or t
  misc_feature (5)..(6): n is a, c, g, or t
ccncnnagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagtcctatcggggcctcctctctgtggtgcagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacca

SEQ ID NO: 464685 - DNA, 3535 bp, Homo sapiens
  misc_feature (3)..(3): n is a, c, g, or t
  misc_feature (5)..(6): n is a, c, g, or t
ccncnnagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagtcctatcggggcctcctctctgtggtgcagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacca

SEQ ID NO: 464686 - DNA, 2582 bp, Homo sapiens
cttttcaatgcccagacaccagtgaacatctacaagcataaagaccatccaggaaactgtgacttcagcaaacaaactaaataagttaccaaggacaaattctgaagaaacagagtaggggatgttactgacatctagtgggcagaggccagagctattgctaaatgtctcacaagaagtaaaagatttctgcaatgaacactataaaacactgatgaaagaaattgaaaaagacacaaaaaatgaaaagatatttcatgttcatggattggaagaattaatattgttaaaacatccatactacccaaagcagtctacagatcagtgcaatccctatgagtataccaatgacattcttcacagaaatatgaaaaaaaattctaaagtttatatagaatcacaaagtcccagaatagccaaagccatcctgagcaaaaggaacaaaactcgaggaataacattacctgacttcaaattatactacagagctatagtaaccaaaaaagcatggtactgtcataaaaacaaacagaccaatggaacagagtagagagcccagaaacaaatccacatagctacagtgaactcattttcaataaagatgccaggaatacaagttttggggaatcatccaatataccaccacatattccagattgaggtttctactatcattctcttctaaaagaaatcaaggctccatggacagtgtctatatcatggacttcttgccttcagaaagtaaggccttcatcggaagaaattgcaatagaactaagacaagaaagttagctaaagaaaaggttatggtagccaaataattaaaagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtgttagaaactgaataaatggaaagggaacatagaaataacactgaaacagtagctgctggaaactgctaccacatttggagccatggaatcagagagaagaggtttgcattgttaaaatcgaagggatgtagaaggcacttcacacagccggactcggatccttgacagggagacattgcccagttattgctggtacttttgagggggcacaatacaactggttctgggagtgcagaaaaaagtgaaaactgaaacaacttgtatcttgctgaaaccacactatcagaaagagtgagaaaactggaagaatcaggtattttcttccctctcatcctgaaactcttcctgatgtgcttcctgttctccggcatcacaaagcagagaaaacaagggtggacttggagatgaaagacactagttaaataaatgaacattgtatggcttagaaggttatcagaccattcaataaaagttaactctcctttcttttcttttgcatctttggccttgttttctgcttatttattttaccccggacaaaaaaaaaaaaaaaaaaaagaaaaagaaaaaagtttgaaagaaagcatcaccttttaagtttatataaatggcttaaaaataaactttactatactttaataactaattcttaattcttccaaaaagttcatttaacacaaattcagttggattctttgtaatttatgtttagtattcactttgcttcaaaactcacaaaggattctgagtcatagactggcctctttggtttctcctttcggtttccacctctgatagagacatgtgccaaagacatattgctccactaaggaaaacaccagtgccagtgcaatgacaggtaacaactgaaactcgccattgttctcaaagaaacaatagaaatcatgaggactcagagctgaagaatatatgccctttaaatgaggcaacactcctcagctctggacaatcaccgcttgtcagacggctggctcagtattgcctatatcttctgatgttttctaaagtagtcagaaatattaatgtttttattaaatgtataataatctatttattacatattggcagttaattcaattaaaagtatattgggtgagcccaggaaaaaaaatatacattctgctcttgacctacatgagaagctgggctgtgatatttgatatggatttgaggcatggcaaacacttattaagcacaccacttcagcaaaggaaaatttatttaaaaaatcaaactcttaagccagaacaagctaccacagcataaaataaattcccaggggtggcctaatgggatcctgcaggacccagcaagtgatggaagataagttagagaaggaaaactcttgtgttgccagtagctcaggagggtatgtc

SEQ ID NO: 464687 - DNA, 1598 bp, Homo sapiens
cttttcaatgcccagacaccagtgaacatctacaagcataaagaccatccaggaaactgtgacttcagcaaacaaactaaataagttaccaaggacaaattctgaagaaacagagtaggggatgttactgacatctagtgggcagaggccagagctattgctaaatgtctcacaagaagtaaaagatttctgcaatgaacactataaaacactgatgaaagaaattgaaaaagacacaaaaaatgaaaagatatttcatgttcatggattggaagaattaatattgttaaaacatccatactacccaaagcagtctacagatcagtgcaatccctatgagtataccaatgacattcttcacagaaatatgaaaaaaaattctaaagtttatatagaatcacaaagtcccagaatagccaaagccatcctgagcaaaaggaacaaaactcgaggaataacattacctgacttcaaattatactacagagctatagtaaccaaaaaagcatggtactgtcataaaaacaaacagaccaatggaacagagtagagagcccagaaacaaatccacatagctacagtgaactcattttcaataaagatgccaggaatacaagttttggggaatcatccaatataccaccacatattccagattgaggtttctactatcattctcttctaaaagaaatcaaggctccatggacagtgtctatatcatggacttcttgccttcagaaagtaaggccttcatcggaagaaattgcaatagaactaagacaagaaagttagctaaagaaaaggttatggtagccaaataattaaaagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaaatgcggccgacattcaaacaacatcctcgctcacaggagacaagt

SEQ ID NO: 464688 - DNA, 1611 bp, Homo sapiens
cttttcaatgcccagacaccagtgaacatctacaagcataaagaccatccaggaaactgtgacttcagcaaacaaactaaataagttaccaaggacaaattctgaagaaacagagtaggggatgttactgacatctagtgggcagaggccagagctattgctaaatgtctcacaagaagtaaaagatttctgcaatgaacactataaaacactgatgaaagaaattgaaaaagacacaaaaaatgaaaagatatttcatgttcatggattggaagaattaatattgttaaaacatccatactacccaaagcagtctacagatcagtgcaatccctatgagtataccaatgacattcttcacagaaatatgaaaaaaaattctaaagtttatatagaatcacaaagtcccagaatagccaaagccatcctgagcaaaaggaacaaaactcgaggaataacattacctgacttcaaattatactacagagctatagtaaccaaaaaagcatggtactgtcataaaaacaaacagaccaatggaacagagtagagagcccagaaacaaatccacatagctacagtgaactcattttcaataaagatgccaggaatacaagttttggggaatcatccaatataccaccacatattccagattgaggtttctactatcattctcttctaaaagaaatcaaggctccatggacagtgtctatatcatggacttcttgccttcagaaagtaaggccttcatcggaagaaattgcaatagaactaagacaagaaagttagctaaagaaaaggttatggtagccaaataattaaaagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaagccagatgcgaaaggtctctgttgggtgagagaaatgaaatattttagacattagcac

SEQ ID NO: 464689 - DNA, 1577 bp, Homo sapiens
cttttcaatgcccagacaccagtgaacatctacaagcataaagaccatccaggaaactgtgacttcagcaaacaaactaaataagttaccaaggacaaattctgaagaaacagagtaggggatgttactgacatctagtgggcagaggccagagctattgctaaatgtctcacaagaagtaaaagatttctgcaatgaacactataaaacactgatgaaagaaattgaaaaagacacaaaaaatgaaaagatatttcatgttcatggattggaagaattaatattgttaaaacatccatactacccaaagcagtctacagatcagtgcaatccctatgagtataccaatgacattcttcacagaaatatgaaaaaaaattctaaagtttatatagaatcacaaagtcccagaatagccaaagccatcctgagcaaaaggaacaaaactcgaggaataacattacctgacttcaaattatactacagagctatagtaaccaaaaaagcatggtactgtcataaaaacaaacagaccaatggaacagagtagagagcccagaaacaaatccacatagctacagtgaactcattttcaataaagatgccaggaatacaagttttggggaatcatccaatataccaccacatattccagattgaggtttctactatcattctcttctaaaagaaatcaaggctccatggacagtgtctatatcatggacttcttgccttcagaaagtaaggccttcatcggaagaaattgcaatagaactaagacaagaaagttagctaaagaaaaggttatggtagccaaataattaaaagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaacagtatggcatcttaaaaaaaaaa

SEQ ID NO: 464690 - DNA, 1608 bp, Homo sapiens
cttttcaatgcccagacaccagtgaacatctacaagcataaagaccatccaggaaactgtgacttcagcaaacaaactaaataagttaccaaggacaaattctgaagaaacagagtaggggatgttactgacatctagtgggcagaggccagagctattgctaaatgtctcacaagaagtaaaagatttctgcaatgaacactataaaacactgatgaaagaaattgaaaaagacacaaaaaatgaaaagatatttcatgttcatggattggaagaattaatattgttaaaacatccatactacccaaagcagtctacagatcagtgcaatccctatgagtataccaatgacattcttcacagaaatatgaaaaaaaattctaaagtttatatagaatcacaaagtcccagaatagccaaagccatcctgagcaaaaggaacaaaactcgaggaataacattacctgacttcaaattatactacagagctatagtaaccaaaaaagcatggtactgtcataaaaacaaacagaccaatggaacagagtagagagcccagaaacaaatccacatagctacagtgaactcattttcaataaagatgccaggaatacaagttttggggaatcatccaatataccaccacatattccagattgaggtttctactatcattctcttctaaaagaaatcaaggctccatggacagtgtctatatcatggacttcttgccttcagaaagtaaggccttcatcggaagaaattgcaatagaactaagacaagaaagttagctaaagaaaaggttatggtagccaaataattaaaagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaacgatggcctcgttggcctaagcggtggagctctgctgtcggttgcctttagtgag

SEQ ID NO: 464691 - DNA, 1000 bp, Homo sapiens
gaaaagagagtcaaggaagggagatggggtggggcccttttataggatttggggctgcttcgagcgggattggggcagcgtgggaacctagagtgggagagattaaactgaaggaagatttgtgggcctctaaaagtattagggcggcagcagctgctgcacggagacatgatgaccaacctaaaacagtaaggtcaagttgtttggacaaaaaggctacaggatgcgatcccggtccttgtgtaagaattctgactgcacagccctgcacttcggctgtgtgtaatgaaaacgattggcatgagttagggagagctagagtgggggcagtctctaaagctgtcttcaaggaatggaaagagaactggggaaaggatttaggatctatggggtcagctaggtttccttttgtgaatttatataatgattttgtcaggatggcaaaaccaggacaggaaaaatgggggaattgtaaggagagtttacaggctttaaaaggccatggtgtggcaggcagtgttagtcttcagccgctaagccaagaagatttgggaaggagtcagagagccttgggccagagttccaggggccctgggagtggctaccagcaacttacaagaaggctttcgcaagaaatgaggctttcacaagaagacccttgtcaagtatctgagagatttcacttctatagcaattacatcgtgagagcactggccctataaagccaagaaggaatgaaaagaggctaagacaaaaaataaacttcagattttgtaacatgatagtctgaaagacaggccaacacaggcagctctttggaaacaagagacctggtacttccaacagccaaaaagctggccaaacatcaggaacaagggaaagacacatcaggtctgagcaagcaggaaatcaactctacaaactttgaaacttggtaaatatgaaaacattctcaataccatttgtcatttaataaatacaaattatactattttactgc

SEQ ID NO: 464692 - DNA, 596 bp, Homo sapiens
cagccattctgctgatagcctgatggcgcccaagtcggtcaagaggaaaggcctgcccctccaaggccaccttctaatctctagcccctttcctaagcaagatgagacagtgtgcagggccaggaaaaaggactgctgcatggataatatttacagacagaaaaagaaaagtgacgtacacaaaatagaagtgggtacagaaacagctgaattggtgatagctcagtctccagccaattacttgagacctaaaacaacagttagtgcagatggaagggtgcggattatgatgcggactacaatggaaacccaaaccttctcttgcagagcgagcccggcacccagctgtcgtccacttgcatttagtgtagctgccacccagcaattaacgcgcctgggctctcctttggaaaccgagcagagaagaacaataccacagcgagttcgcctggacccgaaagcaggtccttgaaaaggatgcaagaaaaaaggaaaaaaaaaaaatccacagcagcctgcagtgattgaagttcaatggcgtactctattatcttctcctgtatgtttaaataaacccccaaagctttctgtttctt

SEQ ID NO: 464693 - DNA, 1553 bp, Homo sapiens
tttcctggactccggttcttgcctctgcccacagtgactgtcgggagctctgctcatcttctgggatttttaaccccacttgctgttgatgaatgcttctaaaatgtgctcctgtgtttcttccacatccaggtgacacacaactcccagctgatggaagacatccccaggcagaggagggagggcaggtaagactcatttcaggaacacattgtattcctaaaatgtgtagttgtttccagaggactcttgagaagggattttgactaggaaacaatgtttgaccacaacaaacatagcagagagctcaaggaaaaccatttgaatatgtatattctgcctgtctagagagattcatcttttttttttctaaaattaaaactatgagcagccaaacagggttatagttttaacctcagggtttaggttccaggtaaatgtgtaaaatgagtgaaacgtgcagagattaagaaagataagtcaaaggacaagaaaactcaacaaatctgaaacattaccctgcccctcttttccccattcactgttgtaagtatctatcttatcattcaataccaaattcctaaaatactgttccacatcttctgcccccattttctcattgttcagtccttttgcaactatttgcaaaaaaaaaaaaaaaagaaatgcatctgattagaattaattttgattaattcgtgttaagttatcaaataaagactcaatagcctctccattaatcccattagagtggggtttcacacctcccatcatgcagccctttttattctcattttcctactgttttactccaggccgtaactcagaaaaacactgtttagtgaagactagttccttaggaagacagacatgcttggctggactccttttttataaccgtatttcccccactggggagaagaccctcaacttttcacctcagaaacattgtttttcaccacaataaaagggttacttttctttcaggaagagattttgtgaaaacgaatgtttcatcaaagagcaaagatagccaggaccagctgattcctctgcttctcttcagctgatccctctgcttctctccagctgatctctctgcttctctccagctgatccctctgcttctctccagctgatctctctgcttctctccagctgatccctctgcttctctccagctgatctctctgcttctctccagctgatccctctgcttctctccagctgattcctctgcttctctccagctgatctctctgcttctctccagctgattcctctgcttctctccagctgatccctctgcttctctccagctgatctctctgcttctctccagctgatctctctgcttctctccagctgattcctctgcttctctccagctgatccctctgcttctctccagctgatctctctgcttctctccagctgatccctctgcttctctccagctgatccctctgcttctctccagctgattcctctgcttctctccagctgttccctctgcttctctccagctgatctctctgcttctctccagctga

SEQ ID NO: 464694 - DNA, 2122 bp, Homo sapiens
ttaatccaatccagtggtgtccttagaagaaaggagaaattaggacacagacatgcagggacaacactgctgtgaggacccaggacgacagatgcagtccacaagcccaggagagaggccgctggaggaaccagccctgcagacaccttaccccggggttgcagcttccagaactgtgagagaagaaaggtcttatgtaaggccccatctgcggcgttttgtcctggcagcccaagcacaggaatgcagccaccaaatgtccacaagcacatttatgtatccagggcctgggtgtttgcagcccccgaggcaaagagaagaaacagccggtgtcaccctgagccactcgcacacaggggcacggacaccccctctcattaaaaacgggttggattgcattccaggcccagcctgcaaagttaatgacgagctcgcaataaagcacccgcgtggatgtgagccttgtactgccccgcgatggccggcgtttttattagtgggcctgggcagcgggcccggcaggctggtatttgacacgcagacaaggatgttcccgggcgcgctgcgcggctgactcacttcaaagtcccagccctgctggcttggtttacacctgagccaattagctccggagatcagaagaggcctgaaaacggagccgagcccttattctcgggatggagaaagtcacttgatcccaggtgacacacaactcccagctgatggaagacatccccaggcagaggagggagggcaggtaagactcatttcaggaacacattgtattcctaaaatgtgtagttgtttccagaggactcttgagaagggattttgactaggaaacaatgtttgaccacaacaaacatagcagagagctcaaggaaaaccatttgaatatgtatattctgcctgtctagagagattcatcttttttttttctaaaattaaaactatgagcagccaaacagggttatagttttaacctcagggtttaggttccaggtaaatgtgtaaaatgagtgaaacgtgcagagattaagaaagataagtcaaaggacaagaaaactcaacaaatctgaaacattaccctgcccctcttttccccattcactgttgtaagtatctatcttatcattcaataccaaattcctaaaatactgttccacatcttctgcccccattttctcattgttcagtccttttgcaactatttgcaaaaaaaaaaaaaaaagaaatgcatctgattagaattaattttgattaattcgtgttaagttatcaaataaagactcaatagcctctccattaatcccattagagtggggtttcacacctcccatcatgcagccctttttattctcattttcctactgttttactccaggccgtaactcagaaaaacactgtttagtgaagactagttccttaggaagacagacatgcttggctggactccttttttataaccgtatttcccccactggggagaagaccctcaacttttcacctcagaaacattgtttttcaccacaataaaagggttacttttctttcaggaagagattttgtgaaaacgaatgtttcatcaaagagcaaagatagccaggaccagctgattcctctgcttctcttcagctgatccctctgcttctctccagctgatctctctgcttctctccagctgatccctctgcttctctccagctgatctctctgcttctctccagctgatccctctgcttctctccagctgatctctctgcttctctccagctgatccctctgcttctctccagctgattcctctgcttctctccagctgatctctctgcttctctccagctgattcctctgcttctctccagctgatccctctgcttctctccagctgatctctctgcttctctccagctgatctctctgcttctctccagctgattcctctgcttctctccagctgatccctctgcttctctccagctgatctctctgcttctctccagctgatccctctgcttctctccagctgatccctctgcttctctccagctgattcctctgcttctctccagctgttccctctgcttctctccagctgatctctctgcttctctccagctga

SEQ ID NO: 464695 - DNA, 1156 bp, Homo sapiens
aaaatacgctgaggcgcaccccacgcggtaaaaaaaacaaagaccctggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatcttcctggctaatgcagttttcttttctgcttctgtttgcctcaaaataggaaaattctttgttctgaaacatcatctgaaataagccagctttaaaatactgtgatttctcttgatggcacttaaaatgttttaggtggggcatggtggctcatgcttgtaatcccagcactttcagaggtcaaggtaggagaattgaggcctggagtttgacactagcctgggcaacacagggagaccctgtctctacagaaaaaaa

SEQ ID NO: 464696 - DNA, 1157 bp, Homo sapiens
ccacaattataacacacaatgcacacgaaaaagacacacaccccctgaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatcttcctggctaatgcagttttcttttctgcttctgtttgcctcaaaataggaaaattctttgttctgaaacatcatctgaaataagccagctttaaaatactgtgatttctcttgatggcacttaaaatgttttaggtggggcatggtggctcatgcttgtaatcccagcactttcagaggtcaaggtaggagaattgaggcctggagtttgacactagcctgggcaacacagggagaccctgtctctacagaaaaaaa

SEQ ID NO: 464697 - DNA, 3136 bp, Homo sapiens
tgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacaggtaaatccgggagaaccgagagctgctctggcggcaggcgaggggctgcaggccctggctgaacaggtgccctctgcagcgccggcgggaggcgcggcgttcgcctcccctgctcggggcctggcacgcgctgggcgttgctctttgttggcttgtgcgtttaacagcttttgcagagccgcctccatgtggtttcggagtcgaggaagacctgggtgggaacccggctctgccgcttcctagccgcgtgataagaacatatgctgtcggcgactcactttcttctctaaaaattgggaatagtaacatgcacctcccgagctttggactaacgttatgtctggggagcccctggcacagtgcttgattggagggggactctgtgctcagtaattggtggcagctctgttactgtaccggcgctgggaacacaaggagaaagacaatatgggatggtcggaggcagaggtgtttccagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaagggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatcttcctggctaatgcagttttcttttctgcttctgtttgcctcaaaataggaaaattctttgttctgaaacatcatctgaaataagccagctttaaaatactgtgatttctcttgatggcacttaaaatgttttaggtggggcatggtggctcatgcttgtaatcccagcactttcagaggtcaaggtaggagaattgaggcctggagtttgacactagcctgggcaacacagggagaccctgtctctacagaaaaaaa

SEQ ID NO: 464698 - DNA, 3040 bp, Homo sapiens
tgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacaggtaaatccgggagaaccgagagctgctctggcggcaggcgaggggctgcaggccctggctgaacaggtgccctctgcagcgccggcgggaggcgcggcgttcgcctcccctgctcggggcctggcacgcgctgggcgttgctctttgttggcttgtgcgtttaacagcttttgcagagccgcctccatgtggtttcggagtcgaggaagacctgggtgggaacccggctctgccgcttcctagccgcgtgataagaacatatgctgtcggcgactcactttcttctctaaaaattgggaatagtaacatgcacctcccgagctttggactaacgttatgtctggggagcccctggcacagtgcttgattggagggggactctgtgctcagtaattggtggcagctctgttactgtaccggcgctgggaacacaaggagaaagacaatatgggatggtcggaggcagaggtgtttccagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatcttcctggctaatgcagttttcttttctgcttctgtttgcctcaaaataggaaaattctttgttctgaaacatcatctgaaataagccagctttaaaatactgtgatttctcttgatggcacttaaaatgttttaggtggggcatggtggctcatgcttgtaatcccagcactttcagaggtcaaggtaggagaattgaggcctggagtttgacactagcctgggcaacacagggagaccctgtctctacagaaaaaaa

SEQ ID NO: 464699 - DNA, 1668 bp, Homo sapiens
tcaggagatcgagaccatcctggctaacacggtgaaaccccgtctctactaaaaatacaaaaaattagctgggcgaggtggcgggcgcctgtagtcccagctactcgggaggctgaggcaggagaatggcgtgaaccccagggggcggagcctgcagtgagccgagattgcgccactgcactccagcctgggctgtctcccccacaaaaaaagaaaagaaagaaaagaaagaaagaaaggaaggaaggaaggaaggaaggaaggaaggaagaaagaaagaaatgaggtatcgaaccatgaaaagacataaaggaaacttaaatgcatattactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaagggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatcttcctggctaatgcagttttcttttctgcttctgtttgcctcaaaataggaaaattctttgttctgaaacatcatctgaaataagccagctttaaaatactgtgatttctcttgatggcacttaaaatgttttaggtggggcatggtggctcatgcttgtaatcccagcactttcagaggtcaaggtaggagaattgaggcctggagtttgacactagcctgggcaacacagggagaccctgtctctacagaaaaaaa

SEQ ID NO: 464700 - DNA, 3016 bp, Homo sapiens
tgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacaggtaaatccgggagaaccgagagctgctctggcggcaggcgaggggctgcaggccctggctgaacaggtgccctctgcagcgccggcgggaggcgcggcgttcgcctcccctgctcggggcctggcacgcgctgggcgttgctctttgttggcttgtgcgtttaacagcttttgcagagccgcctccatgtggtttcggagtcgaggaagacctgggtgggaacccggctctgccgcttcctagccgcgtgataagaacatatgctgtcggcgactcactttcttctctaaaaattgggaatagtaacatgcacctcccgagctttggactaacgttatgtctggggagcccctggcacagtgcttgattggagggggactctgtgctcagtaattggtggcagctctgttactgtaccggcgctgggaacacaaggagaaagacaatatgggatggtcggaggcagaggtgtttccagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatcttcctggctaatgcagttttcttttctgcttctgtttgcctcaaaataggaaaattctttgttctgaaacatcatctgaaataagccagctttaaaatactgtgatttctcttgatggcacttaaaatgttttaggtggggcatggtggctcatgcttgtaatcccagcactttcagaggtcaaggtaggagaattgaggcctggagtttgacactagcctgggcaacacagggagaccctgtctctacagaaaaaaa

SEQ ID NO: 464701 - DNA, 2619 bp, Homo sapiens
tgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaagggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatcttcctggctaatgcagttttcttttctgcttctgtttgcctcaaaataggaaaattctttgttctgaaacatcatctgaaataagccagctttaaaatactgtgatttctcttgatggcacttaaaatgttttaggtggggcatggtggctcatgcttgtaatcccagcactttcagaggtcaaggtaggagaattgaggcctggagtttgacactagcctgggcaacacagggagaccctgtctctacagaaaaaaa

SEQ ID NO: 464702 - DNA, 1608 bp, Homo sapiens
tgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacaggtaaatccgggagaaccgagagctgctctggcggcaggcgaggggctgcaggccctggctgaacaggtgccctctgcagcgccggcgggaggcgcggcgttcgcctcccctgctcggggcctggcacgcgctgggcgttgctctttgttggcttgtgcgtttaacagcttttgcagagccgcctccatgtggtttcggagtcgaggaagacctgggtgggaacccggctctgccgcttcctagccgcgtgataagaacatatgctgtcggcgactcactttcttctctaaaaattgggaatagtaacatgcacctcccgagctttggactaacgttatgtctggggagcccctggcacagtgcttgattggagggggactctgtgctcagtaattggtggcagctctgttactgtaccggcgctgggaacacaaggagaaagacaatatgggatggtcggaggcagaggtgtttccagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcacttcagagtggaaaagagctcctgaagatgaaaagcatcagacacaatcaaagctcaagataacaaccaggaaagttccgttgagccg

SEQ ID NO: 464703 - DNA, 1150 bp, Homo sapiens
  misc_feature (170)..(170): n is a, c, g, or t
  misc_feature (172)..(173): n is a, c, g, or t
  misc_feature (176)..(176): n is a, c, g, or t
  misc_feature (178)..(179): n is a, c, g, or t
  misc_feature (184)..(184): n is a, c, g, or t
agacatgcagacatcagctccagaatgtgctatggttgagttctgcataagtctcacctgatgggagtatcctcagagaagagctggctgttgcacaggaggcaatgctccctggaaaggaacccagctcctatgcctgggaaacagtcacattgcttcagggtcacaananntcntnncttcncaggcccagccggaagacgcaaggccacttgcgtcagcagcgtgcgtcagcaaggtagcagaagcaggaagagagccagcaagaagacacctaccctggcaggaagacacgtacccgtgaagatagagaaagaggccatccagttcagtctcattgaaaagaaagatgtctacatcattgagaacaaaaagaagcccaatgtggattcagcacaattaacacggagtacttgtcaaggcacagacactgcaggaataaattgtaggctgcatttctggtcttaggactcagtcaaatgggacatacaagccatgcaagccaacagcataattgaagacaaggtgttggaaaaacaatatgaacaagtttttataggatcaaaggaaagaaagaattcgactggatctgaggagtacaagaatattccagaattggggaataaataggagagatcaacagaaaggccatttgaatcagaaccagcaggcaggaagtatgaaaccatctagcagcctgttctgtaaggacaaaagatcattaaataggcaaatagcaagctttattgcagaaagccagggatagtatggtttagctttctttaattcctctttgttgagtttcccattgtcttagaaattattcaggaggtaagacctactggtgtatggcacagcaggaatatcaggcctattaatcgcaatcaagtctctaatgcttgtattaataaatcatgtttaatgtagaataatttctgaaaataatgccacagatcaataaataaatctctaagaaaagctgaagttcccagggtcatatctgagaacttgaggccaggggagtttagacactctaagtagaagacacccaggcaagacttttgtggataaggacaattatacaagttcatagccttctgaaataagcttagttctaataatctcaggaaaaacacaaaataatttagct

SEQ ID NO: 464704 - DNA, 936 bp, Homo sapiens
ctctctgagggagccctgggttgggactgtgtctcaatcggccatgacagctgagcaggggagcactgccttccgccccgaagcactgaggctagggaaggcagcaaagccagaaaagactcagggatcttgcctaagagggagcaaggaagggcttgactttccaatcaggaaagggaaagagccagggagtggacatgaggcgaccctgctaacattcaccatacctgcctcctattgggtaagggttaggcagattgaccttcagcttggatgggccatggttggtctacagctaatatgtgattttgtgcaagaagatgagcaaaacaaagacatgttgcaggccgtgttttctggacggttgttgagtcaagaaggattcagccctgttaggagtatggactctggagtcatagggctggaatgcaaatctcagctctatcgtttaccagctgtgcaacttgggcaagttactctctattactctgtttccacatcgtagaatgaaaggattgcttctgctttaacctctgatgctttatcaaggccgagctgagggctgcactatcgggagcttgatgaggaaactgaggcacagagagatgaaggaacttgcccaaggtcacacagctgaggaacccaggcactcagattctggggcctgctctcataaccacaatgctacatccctgcctctaacatcgggacaaccaggccttcctcacaggcattatcgggactataagataagatgcataaggttttatctccagagagaaggcagctatggtccaaggtcaaacacagaggctacaactagaaacctctagaccaagtttggtccatgtggtgttctctatagagtttctttctttttaatttggattttcaatactttaaaattaagagcacacacataacagtatccttttt

SEQ ID NO: 464705 - DNA, 470 bp, Homo sapiens
gcagaaccgctctgagaccagggggagcttttccagtagaatgaaaggattgcttctgctttaacctctgatgctttatcaaggccgagctgagggctgcactatcgggagcttgatgaggaaactgaggcacagagagatgaaggaacttgcccaaggtcacacagctgaggaacccaggcactcagattctggggcctgctctcataaccacaatgctacatccctgcctctaacatcgggacaaccaggccttcctcacaggcattatcgggactataagataagatgcataaggttttatctccagagagaaggcagctatggtccaaggtcaaacacagaggctacaactagaaacctctagaccaagtttggtccatgtggtgttctctatagagtttctttctttttaatttggattttcaatactttaaaattaagagcacacacataacagtatccttttt

SEQ ID NO: 464706 - DNA, 759 bp, Homo sapiens
tttgtgtcaggcttcttttattccacatcatatttatgagctatatctgcattgagaagaactataggagtaattttcttcactttatactagttcatcagaggaaaatatcacaatatatttattctacagttgatagacacgtgaatttgtctgggatccagttcctggaccatttcagactcgtgttctagcctggcttcctagctgaggtgtcttaggaatggtggtactgttcctagctgctgctacagatgggaagccttctgtgctatgctgcctggtgagaaagatgctgtagctatgccccagccagattggtcctgtaaggctttggcctttccagttgttgcttggagaaattgctgactcaccttggaaaaaggaggagttaacagctcatggtggattttgaccaatggaagatggagaagaggaagaagctgaggataaattattttcttttccaatcaccaataaacagatacatgtgaaatgaggtacttagatggcctcttagaaaacatcctgggagatcaaggcatcagttgcaattgctgtcaaataaaggccagttctgttccacttcccctgtgttttctcctcttctttccatacctaatttgggattccttttcgactcactcctgtgtctctggagtcatactcctcaataaaatgggagcacgtacacttttgactaaggctctgttttctagaaagcccagaaaatccctcccaggaccagctacatagttg

SEQ ID NO: 464707 - DNA, 1366 bp, Homo sapiens
ttaggtaaaattcacgctttgaaaaacattggactaagttcctgggtaatggtgggcgcccctcccctagcctcgctgccaccttgcagtttgatctcagactgctgtgctagcaatgagcgaggctccgtgggcataggaccctccaagtcatgtgcaggatataatctcctggaaagggaattccctgaccccttgcacttcctgggtgaggcgatgcttcaccctgcttcggctcacgcttggtgcactgcacccactgtcctgcacccagtgtccctcaatccccagtgtgatgaacccagtacctcagttggaaatgcagaaatcacctgtcttctgtgtcgctcacgctgggagctgcagactggagctgttcctattcggccatcttatattagtgaatttttaaactcatacttccgagagaataggccttcctctttggcagccaacatggaaacaggatgaacaagaccaggaggaggttttcctctgtttcacaggagcacggactattctctcatgttgaatgtggcactttttacatacaagcaggagagcaactacaccaagattttggaaaacatgttatgtaaggttaattgtgacctctatgatggggatatgataaagaagaaaagtacctcacagcgatgattggcatgtgatcacttagccaatgagataagaggctgtagaaacgatgtgataatgacatctcctgagttgcaggtccatattagaagtggatatgaagtaaacattgagctttcctcacatttaattaacaagctttattatagatacagctcaaattagttaattcaggaagcttattttgtagaaattaaaacattaataaacacatacatttagaaataaagaactcggctgaccctttgactctttgaaacaagcattattctttctgatcagtttcaaacatttcaaatgattcttataaagaagggtaggagtggggtggatctatgtaacgaatgctttttttttttggtcttagttcaggctgctatagcagaagactgagtggctaataaataacagaaatgtattctccacagttctggaggctggaaagtccaagataagggtgtcagcatggccagattctgtgaatatttgaagagaaaacgaagaggttattaaatgtgtttgggaatatcataattataataggtaagcaatattcatgttgttactattgtgtcttttcctttgtaattattaggaaagctagtggaaaaaataaaatagaagtatttgccttctctatgcctttttggaatgaaaaataattggcacttgacatgaaatagaatacagaaaccgtatcctgaagcac

SEQ ID NO: 464708 - DNA, 916 bp, Homo sapiens
gtgtgctcttgtgattgtgactgacacaggcagcaccctttgcagaagtagatgtgcgtgctgagaaattttctgcctaagttctggttttctttgcagcacccagcattgtttctaacacagggaaagagtgagctgtaaaaacctctcaaattcaagaaagcgtaaagcaaattgaacaatacgggtgaggagcacggactattctctcatgttgaatgtggcactttttacatacaagcaggagagcaactacaccaagattttggaaaacatgttatgtaagtttttatttttaaaatcaggagagaatttctgcaacatcctatgaccacagatccctacccatctgcattggggcacttacagatcaccttctcttctgaactttgtatgaagtgaccatgtccctcctatccctttccatgtgcacaagatcatgtcatctctagcttattcaaagacattgccttagcaatctgcccttgccttctgtttcatcattgttgcttggagaaattgctgactcaccttggaaaaaggaggagttaacagctcatggtggattttgaccaatggaagatggagaagaggaagaagctgaggataaattattttcttttccaatcaccaataaacagatacatgtgaaatgaggtacttagatggcctcttagaaaacatcctgggagatcaaggcatcagttgcaattgctgtcaaataaaggccagttctgttccacttcccctgtgttttctcctcttctttccatacctaatttgggattccttttcgactcactcctgtgtctctggagtcatactcctcaataaaatgggagcacgtacacttttgactaaggctctgttttctagaaagcccagaaaatccctcccaggaccagctacatagttg

SEQ ID NO: 464709 - DNA, 1052 bp, Homo sapiens
gtgtgctcttgtgattgtgactgacacaggcagcaccctttgcagaagtagatgtgcgtgctgagaaattttctgcctaagttctggttttctttgcagcacccagcattgtttctaacacagggaaagagtgagctgtaaaaacctctcaaattcaagaaagcgtaaagcaaattgaacaatacgggtgaggagcacggactattctctcatgttgaatgtggcactttttacatacaagcaggagagcaactacaccaagattttggaaaacatgttatgtaaggttaattgtgacctctatgatggggatatgataaagaagaaaagtacctcacagcgatgattggcatgtgatcacttagccaatgagataagaggctgtagaaacgatgtgataatgacatctcctgagttgcaggtccatattagaagtggatatgaagtaaacattgagctttcctcacatttaattaacaagctttattatagatacagctcaaattagttaattcaggaagcttattttgtagaaattaaaacattaataaacacatacatttagaaataaagaactcggctgaccctttgactctttgaaacaagcattattctttctgatcagtttcaaacatttcaaatgattcttataaagaagggtaggagtggggtggatctatgtaacgaatgctttttttttttggtcttagttcaggctgctatagcagaagactgagtggctaataaataacagaaatgtattctccacagttctggaggctggaaagtccaagataagggtgtcagcatggccagattctgtgaatatttgaagagaaaacgaagaggttattaaatgtgtttgggaatatcataattataataggtaagcaatattcatgttgttactattgtgtcttttcctttgtaattattaggaaagctagtggaaaaaataaaatagaagtatttgccttctctatgcctttttggaatgaaaaataattggcacttgacatgaaatagaatacagaaaccgtatcctgaagcac

SEQ ID NO: 464710 - DNA, 2089 bp, Homo sapiens
gctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagaagcaagagcagtctgtgatagaattatggcagcaagttcttaaccctttccagattaccaaactctgagaatctgacatagcctgagagtcttttctctcccttgaaaatagccattaattcagtgactgtttggagctgtgaggaaaaaaaaaaaaagaaaatagccattagctcatgtgtacacaattcaaggtacaatatccagagcttagagggcccattttgggctctagattaaggacttctactacagaatattggaaataaatgtcaatggactgcttaaataaattatagtacatccataacaatggagtattgtgtgataattaaaagggagggagacctattatcccctactttggaccaacctccaagatattattaggtgaaaaatgcaagatacaggatactttttatgttattttagctattgtttgtgttaaatgtcaaatgcaatgtacagtaatgtatgaaaaggtggtacaaagtgtgtcttttatgaaggaactggataggagagaacagggaacctggttttcactgtatgcattttgctcccttttgaatttcagaccatgtggaggcattacctttaacaagagagttaatcaataatctttttaaaagagctgaacataagcataattaggctgaaagaaactgggagaattatctcttgtcgtctttgccacttctgaagaactgcttcccccaatgaccctcagattctgataagtaaaaatttttaaaataataaaatagtgatttatctaaatggttatattattcaaggttacaaatagaagctacttgttatgaactaaatatgcctaaattagataaattcaaaattttatatctgcattatttccttttaaattgaaccccagaaaaagagtttttatttttctagttactttatggaaaattttatggccattattgccttgaaaaagcaacaaaagaaaccagaagtttcttttgttctcttatttttaagtggttttgttctggtttgtttggcagaggtgttaactcagcttaatcttgtaactttttccttatgattgaatttattttattggatttgtttctgttagaaaagtaaaatatattcgttgtaacaagtcaaacaattcagagattttggattaaaaaaaaatgtaaactccccacggtaaccaatgtggaacaaagtatggcagccttctgtgcctttgggcatggccaaacccaaaggctttacacatatacacataatggactttttccagaaatttttaccatacgatacctgttactcagcagagtgctttaaaaaacaatgacatttatgacttctcttcaggataataggtctaa

SEQ ID NO: 464711 - DNA, 1087 bp, Homo sapiens
agatttcaacatatgaattttgggaaaacacaaacactcagatcacacaattgaggagaaaccagtgaaaactaactttcatgagaatgaaaaggaagaggaatctgtccgagaaacaagccttgaggtcttaaaaaccctggacccactggtcattggaatgcctcaggtgctatggccaaggatcctgacttttgtggtacctgcagaatacacagaagctctggagcccctgtttagtatcatcagaattctgattatggcagaggagaagaagcagcacagtgccaaggagtcgacagcacttgtcatctctacgggagctggtctgtacattcataaacacagaaaagcttttctattatgagggatccatttccaggaaggctacagtgctttgaccttaaacccaaccccaatctctaacccctgcagtgatgatgaaaattgctttctctttctagtgaaacttccttcaccacagcagctactggccagacttctggtaatatctatgcctgccagtttaggggagttacgtggggctggtgcaatagggcttttgaagatactgcctgagataattcacccaaaattggtagacctatggaaaacacgtttacctgagcttctgcagcctctggaaggaaagaacatcagtaccgttctatgggaaaccatgctgcttcagttgctcaaagaatccttatggaagatcagtgatgtggcctggaccattcagctgactcaggatttcaaacagcaaatgggcagttacagcaataactccactgagaagagccttttttctgggaaaaagagcctgaccaagacagatgtcatggtcatctatggagcagtggccctccatgctcccaagaagcaacttctctccagacttaatcaagatatcatatcccaagtcctgtctcttcatggccagtgctctcagccattctgacccatataagacaatatttcattgtgggtttgatttgcatttctttgatgagcctttaccctttttccttaccaaagtctgttgagcctctttaaaatgattgtgaaggctgaaaacacaagactc

SEQ ID NO: 464712 - DNA, 1883 bp, Homo sapiens
aggaaaaccagagacctttgttcacttgtttatctgctgaccttccctccactattgtcctatgaccctgccaaatccccctctggaatttcatcagcagaaagaattacgtacagatactgataccatgtgtttccaaccaacagctcagccagatcatcctacagtgaagctctcaggaaacaagtaccatctacaagcttcccattgggcctttcaagcgagcaggggcgtgactccgggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcaggtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgccgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctga

SEQ ID NO: 464713 - DNA, 1747 bp, Homo sapiens
aggaaaaccagagacctttgttcacttgtttatctgctgaccttccctccactattgtcctatgaccctgccaaatccccctctggaatttcatcagcagaaagaattacgtacagatactgataccatgtgtttccaaccaacagctcagccagatcatcctacagtgaagctctcaggaaacaagtaccatctacaagcttcccattgggcctttcaagcgagcaggggcgtgactccgggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcaggtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgccgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctga

SEQ ID NO: 464714 - DNA, 431 bp, Homo sapiens
gtaaataagaaaatatgtagtctataaatttaactattaaggtgttaaaaagaactataagtgaacattttcctgatttgattattttttaaatccttggtgtagtcgaaccaaattccgccacagtcagcagttatttcctgacggttctcctggtgaccagtgggtaaagcacaggcaaccactgcagcaaaagccatataataatcattctgaaatgtctgaccttttaaaaggaaaggtgagtgatacacaattacagtcttttcagaaatttagatcatttggctttgaaatttttctcaattggagaattacatcttaatagttacagagagctctgagttactgatcaaagcctgtatgttccttacttatgatttgaagcagggctgaggcttcttaatgtttacagttccggtgtaaatcca

SEQ ID NO: 464715 - DNA, 1850 bp, Homo sapiens
aggaaaaccagagacctttgttcacttgtttatctgctgaccttccctccactattgtcctatgaccctgccaaatccccctctggaatttcatcagcagaaagaattacgtacagatactgataccatgtgtttccaaccaacagctcagccagatcatcctacagtgaagctctcaggaaacaagtaccatctacaagcttcccattgggcctttcaagcgagcaggggcgtgactccgggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcaggtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatggtaagagttatagctgtcacactaagtaggcagttcatcctctgaagagtgaaacaagggcattgccaaagcacaggaatgttacttgttttgttcttattttaattgatatactagtaggatttttgtgtagctgacttgtgcactattcacactaaaaatctctggctgctcttaattacaaatgtataatgttgatgcaattgtacatctaattttttatgtggctgtttattttaatatcaatgtgtactcaaacctgttctctagagcaattatttggctattgctccatgtttttctaaatattatttcagtgagggtaaaagtttggggggatttgactatttttttcttcaagttgatagagtttagaaaataaaaaaaacacagccagtgctattgtcattagattttgcttgatgacaaataacaaagcagttttctttcattcttttgtttagtcagtcctccaaaagttaattcataactcacagtctcctgcgttatcttttctgtaagttctgatatttgtatattaggttttcttattgtagcttcacctgtttttcatttattgactgttttgattgacatcttttgtgtttctatattttcc

SEQ ID NO: 464716 - DNA, 2593 bp, Homo sapiens
aggaaaaccagagacctttgttcacttgtttatctgctgaccttccctccactattgtcctatgaccctgccaaatccccctctggaatttcatcagcagaaagaattacgtacagatactgataccatgtgtttccaaccaacagctcagccagatcatcctacagtgaagctctcaggaaacaagtaccatctacaagcttcccattgggcctttcaagcgagcaggggcgtgactccgggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcaggtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgccgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcag

SEQ ID NO: 464717 - DNA, 1202 bp, Homo sapiens
aggaaaaccagagacctttgttcacttgtttatctgctgaccttccctccactattgtcctatgaccctgccaaatccccctctggaatttcatcagcagaaagaattacgtacagatactgataccatgtgtttccaaccaacagctcagccagatcatcctacagtgaagctctcaggaaacaagtaccatctacaagcttcccattgggcctttcaagcgagcaggggcgtgactccgggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcaggatatgtgaggattacttcatgaaaacaaggaagtgaattaaggaggatgaaaacaaaaagacaagacacatgacctctgtgggataaaggcacagggaactataggatgcttgtgaaagggcagtgtagagttgacagatgtgtaccaggtgtagaggacagctgatccagactagaacagatcagaagactagaagtcttaaagatgaaactgatgaatctgaattgtggggaaaaaaaatccaaaatgaaactgatggatctgaaaagaaaattcacaatggagatgattatgtcagaatatccaaaaaggagccaggagggcataaggagttggatcctggtcacatacacatctagatggagtttcacctgctgaactgggccaaagtgtaaaactagctgcatttgacttgagttgtatatactgggcctgatcaaccgcctggagagataaccatacccaactatattgatcattgactagagacatcctgagctgacaaccagccatcatttatcatggactgtgctaaaaccttccagatacgtaaatttacagtagcccttaaaagctctgcctaaccttgcctgaatgcaacatgatttagctgcttgctagacttgtgtctcccaaattgcaatctctaaaaacctgattaaaatgccttttgctactccagt

SEQ ID NO: 464718 - DNA, 2339 bp, Homo sapiens
tgggtggagccctcgccagggaccccacccttctctacccagcactcccctgccccccttccatgtcaacatgaaagctgacattggctcctgggaaccaacgtcctcctgtccccaaacccatggaggagtggtgggttcctgggcctctagtaactcgactgaatattttccaggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccaggatggctccttgaacactacatcctctagggggttggagaacgctggtactcatgtggcagaagaatggaaggggcaagagaaggagagagggccaacttgccttttataacaagcctagtgccactctaacaacctactcctgaaaaaaaacaaaaaacaaacaaacaaacaaaaacagtattaatccattcataagggtgaagacctgatggtctaatcacctcttaaagactccacctgttaacactgttactgttaaagcagcaattacatttcaatgataagaagatccagccaggtgccatggccctaatgtgtacagctcatgcctttctgcagggattaaggtgggcgttttcaaattgtgattgcagcccatggtaggaaaagattttcactttttggcccagtggaacacatactcatatacacacaactgaaaaagaaatgtttaaattacaaaacagtgtttatactttcttcatgtgatgccctttgttgttttctaaactactctatgctttattttcaaaaattgctggttacaactcactaatgatttcaagactcatgaatgaacctcaaatcacaatttggaaaactctggcttgaggtgtgtttgggacctggaatcagcctgcacttccaatccaggaaagaaaagtggaagaacatgagcacgtgagaggagtgagaggctggggtggaagaggttctctctggacagtcttcccacccaccccaggccagcccatgacagcccaagcagttcttgccatttaactcttgtttgcagttaacgccaatgcttgtttggctgaaaaatgcacctgtccgctatgtggttgccatttcaaagtagaaaactccagaacagtggtgatagggtagagctagcatttttaaaagaattttctttacaaaatgttggcaaggataagaaccacatatgcaaataaatgaccgtgtcccagctacttgggaggctgaggcaagagaatggcatgaacctgggaggcagagcttgcagtgagcagagatcgtgccactgcactccagcctgggcgacagagcgagattccgtctcaaaaaaaaaaaaaaaaaattcaaatcattattaaacatttttactaattaaatggttttggagtacattctttaaaaaaaaaaataaactgtgttttcttcaacaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcggtatgtgcttttgtgtgtgtattagccagggttctctagagggacagaattaatagaatatatatatatatatcctatatatatcctatatgattgtgaaagtcaatacttaacacaatcacgatcttgtgatcgtttcttctaaaatatcatcatcatcatcatcatcatcatcatttttattgttctgcacaaacaccatcataatatttaacagaaatgagaaaaggattcagccacaaatgttactcatcagctaaaaagttcttactttttttttttttttttttggatttctctccaagtcgagtatgagctgaggactgttttacgtaatggcagttctaagcagatccatttgcagactgccttattttcctttgctttatatcatgtgtgtttttccacgtggccaaaaaaaatcctaacaatgccgagcacttcctaatatcttgttaaaaagacacatcaaataatttacgtaactgttccctggtggccagatatttttcattttttctgactttcaagtattgtaaataatgtataatgagcttgtgcttgtagctttccctttcttccggctgacttccagctgacttccttggaataaattccc

SEQ ID NO: 464719 - DNA, 1280 bp, Homo sapiens
tgggtggagccctcgccagggaccccacccttctctacccagcactcccctgccccccttccatgtcaacatgaaagctgacattggctcctgggaaccaacgtcctcctgtccccaaacccatggaggagtggtgggttcctgggcctctagtaactcgactgaatattttccaggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccaggatggctccttgaacactacatcctctagggggttggagaacgctggtactcatgtggcagaagaatggaaggggcaagagaaggagagagggccaacttgccttttataacaagcctagtgccactctaacaacctactcctgaaaaaaaacaaaaaacaaacaaacaaacaaaaacagtattaatccattcataagggtgaagacctgatggtctaatcacctcttaaagactccacctgttaacactgttactgttaaagcagcaattacatttcaatgataagaagatccagccaggtgccatggccctaatgtgtacagctcatgcctttctgcagggattaaggtgggcgttttcaaattgtgattgcagcccatggtaggaaaagattttcactttttggcccagtggaacacatactcatatacacacaactgaaaaagaaatgtttaaattacaaaacagtgtttatactttcttcatgtgatgccctttgttgttttctaaactactctatgctttattttcaaaaattgctggttacaactcactaatgatttcaagactcatgaatgaacctcaaatcacaatttggaaaactctggcttgaggtgtgtttgggacctggaatcagcctgcacttccaatccaggaaagaaaagtggaagaacatgagcacgtgagaggagtgagaggctggggtggaagaggttctctctggacagtcttcccacccaccccaggccagcccatgacagcccaagcagttcttgccatttaactcttgtttgcagttaacgccaatgcttgtttggctgaaaaatgcacctgtccgctatgtggttgccatttcaaagtagaaaaactccagcctgggcaacaagagtgaaactccatctcaaa

SEQ ID NO: 464720 - DNA, 2099 bp, Homo sapiens
agtggtggtggtaatgatgaaggtggtggtggtgacagtggtggtggtgttggttatggtggaggtggtagtggtgatcgatggaggtagtggtggtgatggtggtgctgatgatgatggtgaaggtggtggtgatgaaggtggtggtagagtggtgataatggtggtggtggtcatcaaaatcgtgttggtggatgtagtggtgatggtggaggtagtggtggtaattaaggtggtggaggtagtggtgacggtggatgtagtggtggtaatcaaggtggtggtggtggtggtggtggaggtggtggtggtaatcaagttggtgcttgtggtggtggtattggtgatggtggtggtgacggtggaggttgtggtggtgatgatgctggtggtggtgttggtggaggtagtggtgacggtggaggtagtggtggtaatgaaggtggtggtggtggtggtggtggaggtggtggtggtaatgaagttggtgcttgtggtggtggtattggtgatggtggtggtgacggtggaggttgtggtggtgatggtggtggtagtggtggtaatgaaggtgctggtggtgatgatggaggtggtggtgataatggtgatggtggtagtgatggtggtgatggtggaggtcgttggttgtggtattggtggaggtagtggtggtaacaaaggtggtggtggtggtgacggtggaggtggtggtggtgatgatgctggtggtggtgttggtggaggtagtggtgacggtggaggtagtggtggtagtgaaggtggtggtggtgacggtggaggtgatggtggtgatgatggtggtggtgttggtggaggtagtggtgatggtggaggcagtggtggtaatgaaggtgatggtggaggtggtggtgataatgatggtggtgatagcggtagtgatgaagttggtgatggtggtgatgatggagacagtggtggtggaagtagcgaagggccctatggtagagagaattttggattcagggtggtgatgggagggtttattaagaaaacatcaggaaacagagagggtatttctggtatctctgaaatagtaataataatttcctaggtctgtaacaatgcaaaagtcagaactggttgaaatgtaaaattcaggcaaaaggaataatgaagctttcaaccatgatacaactgagaagatttcagcatccacatagaaagaaaagcagggcaatgcaccctccaagcttaggaaggaggcagccagagaactcctggctcctttgtggggtgagagagctgccctaaggaactccaggcccaaagagagagcaagtgggattagctgcttattgtgtaaacttagaaagggaaaacagaattaaagcttcactgagaagatgaacctgccgatgaggtgtgcagagaactttggctgcacaagttaagaggaagaggctgagtctcagctcagagagtgctggtaatgccaagcacagcagagctgccagagggatctacttggaatctggggaggccctggggagactaactggtacaatttaaagagatgcaaagcaaatgatatgcggggcaatcatgtgaaaagcctgctgccttacaggatggactccagctgctcagtgggacgggctgttgggggctgggttttggtagggcaagagggccccggatggagtgatggacactctaactcactactccgccgtccaatacagtccagattgttcaacaactctgagaataaatggtcttttttaaaaaattggtgtcaaacctactgtactgggttgatgtgaaattgaaattgaaataagttgtatataaaatgtctggcacatagtagtgatcaataaatattaatcccttccccagaccaatgctgtatttccatttctggggcacatgccacattgtctaaatcaatgttttattcactcatacatcaaagataatggaaacacttatattttagaaagaacttactgtacattttatattctttttggtaaattgaataaacactcttcagagatatataaacctagatttcctgatagactttgcattagaacattggtggaagagaa

SEQ ID NO: 464721 - DNA, 3670 bp, Homo sapiens
ggggcgcacccgccgattgtggccatggcggccgcagtctctagtgtggtgagacgagtggaagagctcggggatctggctcaggcccacatacagcaacttagcgaagctgccggtgaagatgatcactttttaattcgggcctctgcagcattagaaaaattgaaactcctgtgtggagaagagaaagaatgttcaaatccatcaaatcttctagaactttacacacaggctattttggacatgacatattttgaggagaacaagctagtagatgaagattttcctgaagactcttcttcacagaaagtaaaagagctgattagttttctttcagaaccagaaattttagtaaaggaaaataatatgcatccaaaacactgcaatttgcttggggatgagctactggaatgtctctcttggagacgaggagccctgctgtatatgtattgtcattctcttaccaaaagaagagagtggctcttaagaaaatccagtttgcttaaaaaggtaagaagacattccttacacatttttcattgttgacatttagaggtttcaaaaagctgtctttgttgtactactaagagtagtggatcaaagggtctgagtttgtattctgtgtcttttatttactagctgggtaatcataaataaattgggcttgttgtgaagactaaatcagataacatgtgaaagcactttgtaatctgcgaagttctttttttaaggatttgtattgttttaaatataagataaactatattaatttctaaacttttaaaaaatttttgtcctgaaagaaacacttgactgtgagcctgtcagcagatcacttctaaggaactcacatgaccctgcttctagaaaattgtggccctctgattcacttgaccattatgactgaatcattaaatccaaaatatgagtcttggtattgtatcactaaggattctaacttgggttaaatgtacacacaatttaggtgggcttgaaatgcgaggccacacttgcagatataaaagtttgatcataatatttctaaattataaccacatacatgtttttaatacattgttgttgagcacatctttattatctttattcttttcttcctctgataacatctttaacaagtatattactgaaatgtgtttctggttaatgtcttctttttttttagtactcttttttactactagagcatttcaaggggtatatttatattagcagagtcttgggatggtgggtctttataccattgaaatagaatagctgtaagctatgcctatatattaaccaattttctcttgagtaaagaatggaaaatattagtatttgaagtttatatatctctgcatataatactttcaattctttggctctgacttttatttagtaccttcttgatggaatcagttacttgctacagatgctaaattatcgatgtcctatccagttaaatgaaggagtttctttccaagatctagacacagctaaattactgagtgcaggtaatgtgatctctcattaaattttctaagtgttttaaagcttcttaagattttaggaagtttgttagatttcactctgatttaaataaatgtcaagattatttttaaatctcactaccttgaagtttgccatgcttcagaaattaaagtcaagttacttcactgctttgaatacatactatggatataaatgtaggcaaaatgaaagattatgactaatattcagattccattttcaataaggcattttataaaaatttaaaaattatttttctattttgtttaaaagacaatgcatggcttttcaagtgagtaatgaagataaaaaccaagctaggttagtctaccattagttcatatgtttttgtagcacatcttttcataacatactgaaattttaatgttttttgcctttaataatagggagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcttatttaatcttcctgtgctgccttatcttatttttaaggcagtaatagtacctacctcaaggatattgaagataaataagttaatattcagagtgctttagttcagtgtgtagtatataagagcacaagagaattagctatttctagactgtttcccttaatgtctagttctgtatataggcatacctcatttagcatgctgactcattagccagacaattgaatgacaaacttgttggccaggaaagcactgccttttccttagttcaagtcatgccggtctttctaggtgggaagcagacttcagagaagaaatcaggacttggataggcatctcaaatgttttttgtggatatgactggaagaaaacatccaattaattttcaaaacattttcagccctccctcaaaatatatataaaacccactgtattgagatgtactagtcatctaaatatgttatacatatcctatttaaaactggattttttaatcagcctgattgccttggcttctgataccttttggtctaattcttaactcacaagtcagaagcattcaatgaaatactggttatttaaatttaaatactatacttaaaaataggttattctaaatccttgtatagccacatgattgagtagtatgtacctgtaaaaatccatgaggtatatttctgtttaacgctacagagtggtcttattaagtaaaaacaaaatggagaaggtatatatatatatgtgtgtgtgtgtgtgtgtgtatgtatcatatttaagaaagggaatataaaagtgcgtgtgtgtgtgtagttaaaaaaaagaaacaatggacccataaccaaaactttaaaaaatggttacttatggtggaggcaggaggagaggaaccagatggaaaggaccaggatggaagctagatttctcagaatatatcttgaattttcaacatttgactttggtacatatgttattctaaaacgagatttaagcaaagttaagaaaagccctacaagtccaaagcaaaatgaaacagacgacctgcattgcatatcaagttgatggcttgaatacacaggtatgtttcagttatctttaaagcatagtaatttgtatgtccattcttaatgggatatatccaagggcaaaaagaaatgtgaagaaatcttaaactcttcagtaattaaattgttaatcataactatgttaatataattagaaatgaggatttttagtgtatgagaaaagatacatacaaaatcaaagagtaaaaacaatctgtaatcctaaatttgaatgggaaataacacgaagttatgttttctctatataaaagacactagaaaggcctggaaaccatgttcaaataccattcccgtcaaaatgagccagagttttctggaaatatagctaattctggcttgagcaggacaatcaaatgactgacggaaaatttttctttaattcagctaataaaaggaattatagaactagaatactaacattttataacttgt

SEQ ID NO: 464722 - DNA, 676 bp, Homo sapiens
ggggcgcacccgccgattgtggccatggcggccgcagtctctagtgtggtgagacgagtggaagagctcggggatctggctcaggcccacatacagcaacttagcgaagctgccggtgaagatgatcactttttaattcgggcctctgcagcattagaaaaattgaaactcctgtgtggagaagagaaagaatgttcaaatccatcaaatcttctagaactttacacacaggctattttggacatgacatattttgaggagaacaagctagtagatgaagattttcctgaagactcttcttcacagaaagtaaaagagctgattagttttctttcagaaccagaaattttagtaaaggaaaataatatgcatccaaaacactgcaatttgcttggggatgagctactggaatgtctctcttggagacgaggagccctgctgtatatgtattgtcattctcttaccaaaagaagagagtggctcttaagaaaatccagtttgcttaaaaagtaccttcttgatggaatcagttacttgctacagatgctaaattatcgatgtcctatccagttaaatgaaggagtttctttccaagatctagacacagctaaattactgagtgcaggaatatttagtgacattcatctgctggctatgatgtacagtggagaaatgt

SEQ ID NO: 464723 - DNA, 1430 bp, Homo sapiens
  misc_feature (1)..(2): n is a, c, g, or t
  misc_feature (6)..(6): n is a, c, g, or t
  misc_feature (8)..(9): n is a, c, g, or t
  misc_feature (12)..(12): n is a, c, g, or t
  misc_feature (14)..(14): n is a, c, g, or t
nnctananntcntnaggccggaatgggtagccacagcaagttctccattgctactgctgctgctgctggagaaggctacaacaatcaatggatactgaaaccatcaggagaaaggttgatggagaacttaaaagtggaaggctcaagctgccaccacctgaatccactgatcaatgctgccatctctaaaagtgactcaagacattgcatgcctcctgctataatgcaatgtgagccatatcctaaaggcagatatgctaaagacaagtctggtttcttcaacgacttaatgacaaagaaatggaggggagtaaaggagcagtccactttcttcagatgttctgtgggtcctctctggatttctggtttgttctcgcagtcgttctggagcaaaattcatgatgagagcctctgcatgctgctctgagtattatattataggtggtacaagtgaatagtaacaatagaggattcattgagtctttagtctgtgttggctacaattctaagctgtttacatatattaactcatttaatccttataacagctctctgagtcaatactgttattgggtccatttttacagatgagtaaactgagacagtagccaacactatactaattactacctcctaatataccctatctcctcactcactgcccctaaaaggaatactcgaactgaatctgagatcctataaattatccctcttcctctctctagcttgcctccctctacacccacataacaagcaatcttctaaaataaataaagaacaacaggatgatagctcttagggtcagcctaataagaaacctcattatttctggtttagaacatttcaaagcaacacccaggaaccttcagaatggtaaaaaaacattgatgcttagctatgaggcatgaggcaggaggagtaatacaaagtggacctttgccccaggatgatgactgaggtatgactagaaggttcttcatcctctcaaagagcaaacttttgtggcagtaacacaaccaggcaagatgcgagaagcagatcaaagaaactaaaaacagagaaagaaatggtgtatcatttcactgtgtaccctgcagggaaataaaggttctgccctacctaccaagatcatattgccgtagcatcaaaaagccccatacaaaataaaagctttcaaaacacagcatggtattaaaaggacatctgtattttaaaagtctcgtttattttgtttactgctgaatctccattgccagacactgccaggcacacagtaggtgcctgtgtactttttatatttacattgtaagtactttacaataagtccattgtaaagtaagtatatttattcattaagtattaaatataagtacttacttatatttaatggactatttaatgaatgaataatattggcacattgcgattcc

SEQ ID NO: 464724 - DNA, 1708 bp, Homo sapiens
  misc_feature (1)..(2): n is a, c, g, or t
  misc_feature (6)..(6): n is a, c, g, or t
  misc_feature (8)..(9): n is a, c, g, or t
  misc_feature (12)..(12): n is a, c, g, or t
  misc_feature (14)..(14): n is a, c, g, or t
nnctananntcntnaggccggaatgggtagccacagcaagttctccattgctactgctgctgctgctggagaaggctacaacaatcaatggatactgaaaccatcaggagaaaggttgatggagaacttaaaagtggaaggctcaagctgccaccacctgaatccactgatcaatgctgccatctctaaaagtgactcaagacattgcatgcctcctgctataatgcaatgtgagccatatcctaaaggcagatatgctaaagacaagtctggtttcttcaacgacttaatgacaaagaaatggaggggagtaaaggagcagtccactttcttcagatgttctgtgggtcctctctggatttctggtttgttctcgcagtcgttctggagcaaaattcatgatgagagcctctgcatgctgctctgagtattatattataggtggtacaagtgaatagtaacaatagaggattcattgagtctttagtctgtgttggctacaattctaagctgtttacatatattaactcatttaatccttataacagctctctgagtcaatactgttattgggtccatttttacagatgagtaaactgagacagtagccaacactatactaattactacctcctaatataccctatctcctcactcactgcccctaaaaggaatactcgaactgaatctgagatcctataaattatccctcttcctctctctagcttgcctccctctacacccacataacaagcaatcttctaaaataaataaagaacaacaggatgatagctcttagggtcagcctaataagaaacctcattatttctggtttagaacatttcaaagcaacacccaggaaccttcagaatggtaaaaaaacattgatgcttagctatgaggcatgaggcaggaggagtaatacaaagtggacctttgccccaggatgatgactgaggtatgactagaaggttcttcatcctctcaaagagcaaacttttgtggcagtaacacaaccaggcaagatgcgagaagcagatcaaagaaactaaaaacagagtaagtggttaaattatttatgatgatgctgcagctgtattgatcagaggcagatttctctcttaaccctactttccttgtacctatagaagttgtcatcgcccaaagaatttttgacctaatgtgaaagtgtgggggttgatggagagagaagtggggggagggagtgggtgaatagctagtcaggaccttagttaagagaacactggttatccaatatggttctaccatatctaatgacaaactaactgatgatctccacatatctcatttcctaggaaagaaatggtgtatcatttcactgtgtaccctgcagggaaataaaggttctgccctacctaccaagatcatattgccgtagcatcaaaaagccccatacaaaataaaagctttcaaaacacagcatggtattaaaaggacatctgtattttaaaagtctcgtttattttgtttactgctgaatctccattgccagacactgccaggcacacagtaggtgcctgtgtactttttatatttacattgtaagtactttacaataagtccattgtaaagtaagtatatttattcattaagtattaaatataagtacttacttatatttaatggactatttaatgaatgaataatattggcacattgcgattcc

SEQ ID NO: 464725 - DNA, 747 bp, Homo sapiens
ctgactctaagcacctctgattagatgtcattctatgtctgggatgatctcaggactatggtattgtcctcttgtgctatcaattttaactcacaaatggatgtcgatgtcatttattctcttattctacagaccttcattggctacatgggtagtatgggcaagagataggtggtcctgacggaggagtgggaagagccagtgctctggagtgggattactttctggctgcctgctcaggaaagttgtttcaccattctcaacctcagtttccacatctgtaatatatggaaattaatttctacctcataggattgttgtaagtattaaatgagatattattgtaatgcttaattaaatgagataatatatttaaaaatataattcccctagatataatacatatgtatacataatatatacatataatacatatgtatacataacatatacgtataatacgtatgtatacataatctatgcatataatacatatgtatacataatctgtgcgtatataatacatatgtatacataatctgtgcgtatataatacatatgtatacataagctgtgcatatataatacatatgtatacataagctgtgcgtatataatacatatgtatacataagctgtgcgtatagaatacatatgtatacataagctgtgcgtatagaatacatatgtatacataatctgtgcgtatagaatacatatgtatacataatctgtgcgtatagaata

SEQ ID NO: 464726 - DNA, 1546 bp, Homo sapiens
  misc_feature (2)..(2): n is a, c, g, or t
  misc_feature (5)..(5): n is a, c, g, or t
  misc_feature (7)..(8): n is a, c, g, or t
  misc_feature (12)..(14): n is a, c, g, or t
tnctncnntccnnngagaggggcagggagaggagaaatggtgcaagattccaacagctctctggagacattgtctctctacctcttccacctctccagcatcaaaggctggtggtggccaccgactgtcctgggtaatcctggtggacagcagagggctgcggtccaacaagaaattctatggaacccctgtacagaggagagtgctagggagcaggagtttcagagtgacccgctcaaggccatcagtggaagagccaggcgtggaactctggtttcccatcttgagggccttgagcgtccctttgcaccagaattttccaaagtgggatccacactgtgccctcggggcaggtgtaccgggggaactgactcagctgcaggaggacagcttcaattccctatgagttcatctcggacccaaccaatcagagctcttgactcactggcttccccctacccaccaagttgtccttaaaaactttgatccccgaatgcttggggaaaccaatctgagtaataataaaactcaagtcacctgcacagctggctctgtgtgaattactctctctattgcaattcccctgtcttgataaaatggctctatctaggcagctggcaaggtgaatccattgggtggttacaatacctcccttagtagactaaagaacaacttggataaaaccagcaagaaatggattatatcgagggaaattgtcatgcccatccaagaccatgataaggaatgaggaagtaacataatggaaggattctgtctcttctcattgggactgactctaagcacctctgattagatgtcattctatgtctgggatgatctcaggactatggtattgtcctcttgtgctatcaattttaactcacaaatggatgtcgatgtcatttattctcttattctacagaccttcattggctacatgggtagtatgggcaagagataggtggtcctgacggaggagtgggaagagccagtgctctggagtgggattactttctggctgcctgctcaggaaagttgtttcaccattctcaacctcagtttccacatctgtaatatatggaaattaatttctacctcataggattgttacctaagtgagaagatgcgctcctgttttcaagcctgaatgttgcattttccaagaccactgtggcctgccacactccccatcctgtgtccatacaaacctgagaccttagagggcacacccacaagtggctgcacattgagaccagcagaccagcagaccagcagactagaagaccagcagaccagcagaccagcagactagcagaccagcagaccagtgatggtggaacaatgcagcagaaaaagagagaaaaggagagacgtctggacaccgaggggagttcagcctgaggtggttggagaagagtccgctcactgggcccaactccagaggaaaccacattcccactccatccccctttctggctccccatccatcttgctgagagccacctccatcactcaataaaaccttgctctcatccttcaagcccgc

SEQ ID NO: 464727 - DNA, 1720 bp, Homo sapiens
gaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagaatctccttggtggcttccattagcaaaaagcaaatcccacaagttcacttcagggataacctgtgatttggatcgtgacagccacatggctttgcctaggttagccctctgtcttgagaaacgcttctctctcctgctgccttgtgaagaaggacgtttttgcttcccctcccgtggtaattgtaagtttcctgaggccttttcagccatgcagaactcacttctttctccggctgccatgtgaagaagaatgtgttttcttccccttccaccacgattgatggagattttgtaatgttcatggactgcctagtggctaagcactgctttgaagaactctgaatcatattattttgctactcagaactctgccctttaacccaacagtggaagccagtgttctgctggtaaatcaggcctgtttagtttggctgaccctgccatggaggcagttttaccagaaaaaaagaagaacaaagatcacagacaggaagaaacaaataggcttccagtgaaagaagccagagaaattgctcaactggagttgtcccagttactgccactgtttcaaaggataaagtacagaaagaggcacttctgaagcactcaccaggctctaaaattagagcaaagttttctaatggtttttactcttacttgagttagtctccaaccccaccatcatccttcagatttcctgagtatagaaatagagaatgcgtagtcaattagaagggctagtaacctgtgagctcatcaggagcctggcagagaaaaactttctgataacagttttatgtagctgcagcctgggaattatcatttcttcagatttctctttcttatgcattgctggtatcccttaaaccatgacaagcagaaaatgtgacagagtcgaggaacatgagggagggacagtggaattcattacaagaatgtatgtgtgtgtgtgtttgtgtgtgtgtgtacatgtgtgtgtctgtgtgtgtaaaaaatcaccaagtcatgacctgaaaaaaggacacttgctttctacctctactttgtcagactttctttatccaacaaaaacatccttacttatttgtattccttctggatgaactgtcctggattttatttattgagttatgtggttatcctaaaggcaagataaatttggggaatataactttccaaatatatgtgactcat

SEQ ID NO: 464728 - DNA, 2321 bp, Homo sapiens
  misc_feature (2318)..(2318): n is a, c, g, or t
ccacagaaaccacaggtaaccagacgcctgcacgtcaggccaccgacgccttggtctacacagcgcagcctccagtgagcccgcggcatgccgcgcggcctccccacacacgatggcgatgtcgcaaccacagtagaaagagtggcgctctctactgtcccggaattcttgaggccggaagaataacagggcaaaggtcacgtagacggcgcgccccgcccccgtacgcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaatggagcttcaaaggcaagggtatacaactaagctttctggaatggctgtgtatggatatcactggcaatgctgctcatcaacccagcctagcaggtgaagggcaagaggaacaggctagacagggttgccaacaagtggtccatacaattcagaccataccactggggtaggtatctggtgtcacaccccagttaccctcccctcagccccaggcaaccagtagtctactttctgtctctatggatttatctattctggacttttacacaaataacatcatataatctgtcaactctgaagacaactctgtgggcagttatctcacacattaaaaaaataaagtttagagaagttaaataaccaccgaagaaggtggaaggggaaccaaattccacttccctgaaacccaggtctggggtctcaaccatgtaccaggcaacaaccttccacttttcccatgatctgtctgattcaaccacaactggtcatgttcattcaatattttctgtttgccaagttagggcaaagtacaacatattcgtagagatatttaccttaaaactaggctttcaaataggtaagttttatttaaaaaaaaaatgtaacaatagccatgaacccagaagcataaaggaggattcatttcattatcaccaatagctgcccatcagaggccaactctctgcaagtctatagtaaaagatgagaaggtggtatttaaggtggaaagaactttgcactgttataaaagactaacttttggctgggcatggtgacccatacctgtaatctgaacactttgggaggcccatgcaggcagatggcttagcccaggagtttcagaccagccctggcaacatagtgagaccctgtctctacaaaaaattttaaaaattgccaggcatggtggtgcacgcctgtagtcccagctactcaggaggctgaggtgggaggattgcttgagccgggaaggtcaaggcttgcagtgaagaaaacaaaacacagggtagtcactctgtatcgaagtgattagtatggcagtggcaagtctcttagtagtaatttattctaaaagtagaataaatgctactgtaatttttactctggttaaaataaatgtgctaataaaaacctgaagatgagatataattaatagttccatgaaatgtgctgctatgtgtgatatgagggctgtaacaatattaattccttacgtttggtctgcttctaagatgttcatcaagtggagtgataatcttcatttgagacaggtgaactctgccagtgtcttctcccttttggcactccaagtaattattttccgtctgcttcagcatcacaagtacatccccacgctgcaagntaa

SEQ ID NO: 464729 - DNA, 1488 bp, Homo sapiens
tttcagaggcgtattgctacatttggggcaatgcgtacatatgtggtttcgttagctccagtgggggctaatcctctgacagagccacctctcacacgaaacactgaatggaggcgatcccgagatggatggagcagcagtagcgcaggttgctgcagctgtgctgccagagattgtaattcaggaaccaatctcaagctgagcagaggaaaaaatgagatgcttcatgaaaatggccaaatgtcatcaccagctattttgtgagaagagctatgttaggagccatccacatgtaaaatggactttcaccaaattccatccatctgccggtcatggaagctcacaacatgtatgtctcctgagggagccttttcgttttgtgctttttctggcactaagaaatacagacacttgtgatttactactgggcacttataggaatggagtcaactatttcctaagaaactcaaagactgaaatgagaaattcagaaaataaaaatattttctgtgttagaaaactatataccagaaagcctgaaaagtgaggcaaagggcacagaaattctggttaataagatgttgtagattagtgagaacttgaacatgtttttgcttctagtatattttttggaatttctaaactatattagctccctttcttaccttaggaattacagtattgtgatcatgtgagaagatagttctaaatattaataaatatttttaacttcatcaaatacgtctttgaagatttcaagggtatgactcgcggatggagcaatggtgagagcacacctgaagaagggaggagaagagattttttttcctgatgcagatagcccctactgctgtgtcattctcctgctggctagggagaacaacaaagaggagaccaaggatggaaggtctgctactgatcttcagagccctggtccagattgtaacaaggggataaagacctcaggaggtggaaaaggctacaaatatgtggaagacctggccatcaaggagcttacagatactcatggatctacatgtggggaggaaacaagcaagctacttctggaaccatttggcggcttggcagcttgctacagagaagctgaaggaggaccaccctggaaaaggacctgctttacccaagtcttctctgccacagtgaggaagccgcccccaccccaccaaccacaggtgctctcccaacccaaatcaaaaagccactggtactatcactaacctctgtcatcctgccccaaccaaaaagatatcacttgcctgccggctttgtcacgtaacttatttctgcattcaggactcacacaggtctacctgcaattccctttcatgtttagggcctgctgaggactgagcagcgtgaaaaaattgactcagtcatttttcaacattattaacaccaatttctaatttgtaaataatactgttagaagtgctagaatgtacattgagtcctagtgaataaattaca

SEQ ID NO: 464730 - DNA, 3593 bp, Homo sapiens
cttaagtagaatttatgattgcgggaaagatgggagcagtgaagctggagagtacagtagaaatcatctcatgtatggtactgaatgctagctgttttgtgttttcaactacagaaatggacagccatggaagagtcttaagcaatagagtgacactgtgtagatttaagttctgtgagatactgactatagtgaggaatggattgagttggggcaatattggtgtcacaggaggtagtatgatcacatctctggaaggtctgggtactgataatgtttttagcttacatgaagataaccattaccggataagcaagagcctggtaaaatctgcggaaggaagtactgtacccctgaccagggtgaagtgtctggtctccatgacaaccccacatgacatcagacttcatgggtcatcagttactccagcttttgttgaatttgacacatcacttgaaggtttggcccctcataatgctcctacaaataataccgtcacaacaggtcttattgatggggctgtggtcagtggcattggttctggtgaaagattcttccctcctccctccggcttaagttactctagctggttttgtattgaacattttagttctcctccaaataaccaccctgtcagacttcttactgttgtgcgccgagcaaattcttctgagcaacattacgtgtgccttgcaatagttctatcagcaaaagaccgatctctgattgtttccaccaaagaggaactcctccaaaattatgttgatgattttagtgaagagtcctcattttatgaaattctcccatgctgtgctcgctttcgatgtggagagcttatcattgagggacagtggcatcatttggtcctggtaatgagcaaaggcatgttgaaaaacagtactgcagccctttatattgatggacagcttgttaacactgtaaagcttcattatgtccacagtactccagggggttcaggttcggcaaatccaccagtggtgagcacggtctatgcctacattggtactccacctgcccaacgccaaattgcctcattggtttggcgcctgggacccacacattttctagaagaagttttaccttcttcaaatgttactaccatttatgaacttggaccaaattatgttggaagctttcaggctgtatgtatgccatgtaaagatgcaaaatccgaaggggtggtgccatcccctgtgtcattagtaccagaggagaaagtgtcatttggcctctatgcactctctgtgtcgtctctaacagtggcaagaatccggaaagtgtataacaaattggatagcaaagccattgctaagcagttaggcatttcctcacatgagaatgccactcctgtgaagttgatacacaattcagcaggacatcttaatggatctgcacggacaattggggccgctctgattggatacttgggagtaagaacatttgtccctaagcctgttgccactactttgcagtacgttggtggagctgcagccatcctgggcctggtggccatggcctctgatgtggaagggttatatgcagcagtcaaggccctggtttgtgtggtcaagagtaacccactagccagcaaagaaatggaaagaatcaagggctaccagaattagataaaaaatcacttgtaagaagaggaacaaatacttgaagcaagattaaaacctatcatacacgaagtacaaatgccttctgcaagtttaaccattagtttattgataatgaatatactgtttactgtgttgtatagatttaattatagtatttcaataagtgttttcttttgcaaaactttcaaaatgattattgcagcgttgtttatcatgaaaaaatagaacaatctagatataccagtaataagagaatgactaattatactctaagcattccatagactatcattcaaccttttaaaattgtaattattaagaccgtgttgcaaaaaaaaatactttataacacaaaaagtgtatatttaagtagttaccatcatgtgcatacaattttatattcttgctgtgatgttttcattatacatacaattttatgcacgcgttggtaactatttacatatttataatggaattgaaagggtaaatgtaaaagtggatattttaatagaatgttaagatccctttgtttttcagattttacctaatgttatattttcataataaaaatttagaaattaacttaataatctcagaaaatcatctacataggattctgtgtgtatgtgtgtgtttgtgtgtgtatgtgtgtgtttgtgtgtgtatgtgtgtgtttgtgtgtgtgtaatgaatatatatgatgatttatcaacaggcatttggtattactttcttgtagttgctggcaatgttgcttaagaagaaacgttcccttcttaacagccacatcctccatctaactttttctttggtgggaactgttgatagtggacatgagacctccattattccaaattcaactgctttccaggacctcctctgtgattttgaagtctggctccatgcaccatatgaacttcatctttccttatttgaacactttattgaactgctcacagagtccagtgaagcctcaaagaatgccaaattaatgagagaattccagttaatcccaaagctgctcctgactcttcgagatatgtctttatcccagcctactattgctgctattagtaatgtcctgagcttcttactgcaaggttttcctagcagcaatgatctgctcagtaaactttccaagaactatgttgtaaattttcttttagcttatctactagggagatttaatgtatttatttttattttaggaactgaagaggagtttggaggtcttgtatcagctaatcttatacttttgaggaacagacttctggatatcttgctaaaactaatttatacatctaaagaaaagacaagcattaatttgcaagcttgtgaagaactggtgaagacactgggttttgactggatcatgatgtttatggaggaacacttacattccaccacagttacagcagccatgaggattcttgttgtcctactaagtaatcagtctattctcatcaagtttaaagaaggactcagtggtggaggatggcttgaacagacagattctgtcttaactaataagattggaactgtattaggtatgggacttttctagtcagctgcttgaaaatgagctggtgtgttttgttttattttaaattttatgtaaacttatcctctgcggtttgatcaccattaaggagatattaattttaattaatgatagaaggaagagcttacaagatttcaaattagtccttttaaatggcaaatcaaactgaagacagagataacatactaagatttgaaaactcagggaattcctcaagatctttttgtagtataggccttactgatctgacttgcaatgtaatcaaaatctattttcctatttaatgtataaaataaccacttgatgtcttttggtttctttttcactttttaaattttttttattttttagagattgggtcttgttatgtggtccaggctagacttaag

SEQ ID NO: 464731 - DNA, 1192 bp, Homo sapiens
gtggatccccgctgcgtttcggcatccacatcctccatctaactttttctttggtgggaactgttgatagtggacatgagacctccattattccaaattcaactgctttccaggacctcctctgtgattttgaagtctggctccatgcaccatatgaacttcatctttccttatttgaacactttattgaactgctcacagagtccagtgaagcctcaaagaatgccaaattaatgagagaattccagttaatcccaaagctgctcctgactcttcgagatatgtctttatcccagcctactattgctgctattagtaatgtcctgagcttcttactgcaaggttttcctagcagcaatgatctgctcagtaaactttccaagaactatgttgtaaattttcttttagcttatctactagggagatttaatgtatttatttttattttaggaactgaagaggagtttggaggtcttgtatcagctaatcttatacttttgaggaacagacttctggatatcttgctaaaactaatttatacatctaaagaaaagacaagcattaatttgcaagcttgtgaagaactggtgaagacactgggttttgactggatcatgatgtttatggaggaacacttacattccaccacagttacagcagccatgaggattcttgttgtcctactaagtaatcagtctattctcatcaagtttaaagaaggactcagtggtggaggatggcttgaacagacagattctgtcttaactaataagattggaactgtattaggtatgggacttttctagtcagctgcttgaaaatgagctggtgtgttttgttttattttaaattttatgtaaacttatcctctgcggtttgatcaccattaaggagatattaattttaattaatgatagaaggaagagcttacaagatttcaaattagtccttttaaatggcaaatcaaactgaagacagagataacatactaagatttgaaaactcagggaattcctcaagatctttttgtagtataggccttactgatctgacttgcaatgtaatcaaaatctattttcctatttaatgtataaaataaccacttgatgtcttttggtttctttttcactttttaaattttttttattttttagagattgggtcttgttatgtggtccaggctagacttaag

SEQ ID NO: 464732 - DNA, 3162 bp, Homo sapiens
acccttcgctgaaaaacttcctgaagctccactgttttctgttctcctattctgaggaatacattgactgattaatctcttttgaaagagcatggcacagaataagtactatgacttgttaaatcagagaggacgagtccccacatccagagtttctaatttagtaggtctggagtggagccacaacatgtgcatttctgacaagttccaaagtgatgctgatactatgggttgggaaccatactttggagaaccactgctaaaaggacatttggtttttatcttccactggctggcacaagggacatgctgtgtgtcactcattaaatgccactgtggtgagtgtccccttttgaacacagctgtgagcctccacactgtggagagaagccagacacaggctttacatgcacctcgagattcctggagaacatatgccatgtgtttgtcatcttttcaggaaagcacttctgaagagccctttaatgagtttcctagagaaattctgaaggaatctacagtagacattcttactgttaataggctgcaataatcctttggttttcaatggtatattgctctcagttcattgtgcagatttcagcaaaataaaagtaaaagaatttccaaaacagaggaatcgtgacagggagaacaagaaatgcaatgcatcaaagcaacacaagatgtcacttttacacaggcctgcatttgcagatttttgtagctgtgtaatcaaaggtattctacttgtctgtgtttattctttgtatatttttaaatgtatattcatctggaatacatctgtgaagcacaagaaataacatttagtcttttctcctattaaattgccttaataaagaataattgattaaaatgatctgaagcctcattctgtgctagtcaatttgccaggagttctacatgcattacactacttaattgttacaacaacactgtgaggtagtcagtcaattctcacttttttatgaggtcactgagacttatgaaggctatggaacttcctcaaggtcatgcagaatcagaatgcagacatgtttgattgcaaagctcaagtctatttaaccactatattactctctgtgcacagaacaaaatgtcaataagaaattttacttggttttacctatgttttaaagatctaagcagataattttttcaaaatttatccagattttctgaatcttcttctaaaggaaaaatatcttatgcctgcataaatgaaaggagaccaagattattgacttactcatttagcaaatacatagcgagcccctatcctccactaggcattgtgctaaatactaaggatatagtaatgataagatacataatcctttacctcatcaggctctgctcctagtgggtagacaaaagaaaagcagaaaaagatgacaacacaacgggctgaaatgaccataataccggtatgtgccaggtactgagagaggacgaaggcttcacgaacgtgtttgaaaccaagacttgataggaattttactttaacggaagatagcggtgagggcttgaacactaaggaattaatgagagatcagcccctttagcgactcaaagcatattataactccagctggtcaaaaagagaggaaataaataatataacaggaacaactggaagagcaagtgcagcatcaggttggtgcatttcttctgatcaaaaggtcgaattgcaactggtctttgaagagtgtgctggtgacagtgtgcaacctttgcagtagctcctggactggccctagactgctgtcaaattaaaccagcactgtaaagaagagagcaagttgaatgaagttgaatgaaggggcatcttaattccaatcctggctctaatgctgactgtaagcatgaccccggatgagttattcactctctcagtctcagtctcctcatccacaaagcagggatcacaataaatgaatagcacctttcacagaacccaccatatatactgagtgttcaataaataccattattgggggatattattcaaattcttctttaataaaaggagctttatccttaatgttttgttagagcctatactgtttttgttgaaatgtactgtaatgaatatattataaagagatagacctgtaatttaaccttggaggaaataagttttacgtagtgctaagttgttctacatttcaggttgattgcatatgcaggacaatagagagtaattgctctaatattcatagcttaaggtcacaagtgtagtacaaatttcattttgttttactggtttgttctcaaatactattttaagttcacttatactgaattttcatgtttggatactaggatctaattatttgcagtatagctagcagtattgcatcaaatacaaattattgtgtttttcgccccacataactccatgttctgattaaaattcagctacactaataagatatcatagccaaactagctcacatgctcacaattgtgttttttaaaaaactcagagtaaaaataatatttcggtgaaaggaatgtcattgactttcactgaaatagtagttcagacttttgttgttatatagctgaataatataaccttgaatgtatttaaatgattcaaggctcttaatttttcatccagcagcattttaagcatcacatgataaaatatacattttgggttaactcattaaataatgtttgcataattaaataggtaaattagcatcaatagagttggtgccattcttatgaaaataaaagcacaataaactatacaacaaaaagtatgtttaggcttttaaataatacatgttgaggttactcccctctgcaatcaaatgatatttatgacttacaaatacaaggtaggctctgttttagatcattcctgttcttgactgcctactttctctgagctgcttctctcacagctctaggctctgggctggagggatgtagccataaacaaaatgctggaagtctttgcctttctatagattgtgttttaacagatgaaaatagatgaataaatacattattaacattgcaaatagtggtaaataccatgaaaagaaacagggcaatggggaggaatggggaaacggggagtattctagagactgtggtcaaggaaggtatttcaaaagagataag

SEQ ID NO: 464733 - DNA, 2300 bp, Homo sapiens
cctgtcacggagaagaacatcctgcagaatttcctgtcacgaggaacattccgcaggaggaaatggaggctgaaaggctgcgactcctcgaggaagaggccaagctgaaaaaggtagccagaatgggatttaatgcatcttccatgctccgaaaaagccagctaggtttcctcaacgtcaccagttactcccgtttagccaacgagctgcgtgtgagctgcatggagcggaaaaaggtccaaattcggagcttggatccctcctctttggcgagcgaccgatttaacttcattctggcgagtaccaacagcgaccagctcttcgtagtgaaccaggtcgaagtcgaaggctccaagtacggcatcatcagtctgcgaactctgaagatcccttcgttccacgtgtacgtgctcagaaacctctacgtccccaaccggaaggtgaagtccctgtgctgggcctcgctgaaccagttggactctcacgttctgctgtgcttcgagggaatcacagatgctccaagctgtgcagtgctgctcccagcgtcgcggttcttaagtgttcacacaagagttaaccagcctggcatgctctgcagtttccagatcccagaggcctggtcctgtgcgtggtccctcaacacccgggcatatcactgctttagtgcaggcttgtctcagcaggtcctgttgaccagcgtggcgacgggacaccagcagtcatttgataccagcagtgatgtcttggcccagcagtttgctagtacggctcctttgctgtttaatggctgtcgctccggggagatctttgccattgatctgcgttgtagaaatcgaggcaaggggtggagggccactcgcctgttccatgactcagcagtgacctctgtgcaaatcctccaagaagagcaatgcctgatggcatcagacatgactggaaagatcaagctgtgggatctgagggccactaaatgtgtaaggcagtacgaaggtcacgtgaatgagtccgcctatctgcccctgcatgtgcacgaggaagagggaatcgtggtggcagtgggccaggactgctacacgagaatctggagcctccatgatgcccacctgctcagaaccatcccttccccgtactctgcctccgaggacgacattcccagcgtggccttcgcttctcggctcgggggcatccggggagcagcaccagggctgctcatggctgtccggcaggacctttattgtttccccttcagctaattctgcaggtggcagcgcggccgaatgtggatttgacttaaggaagttaagagtatcttattaccgtttctgtgagagcattttaagagacgtgttgtatgtagatcgcatccatccggctgccagggaggcaaagaaaaaaaaaatcgccaaaacgtgatgacaacaagtatgtctgtgttcaaaattaaatttgtgttcttggaactctaaaactgacattatcttaagttttagcacttggggaagtttcaaagactttccaaaaggataagtatatcatgatatgtaggtataaataccaagacaactgcagagttattttaatccaagtctgttgaggctttattatgtgatacagcattgtgagagttaaggtaacagaaaatgatacactttgttcttcaaacttatttggcaaatcaagggtactggaggtttataacaattagtagtgtctaagtcaagttacaccccaactataccaggaaaaagaaggacaggaaagcacacactgtgaaattttactgtgcaccaacatattttacacatcaggtgggctgttatggaaattaagaactctgcacaaaatgtattttttttaaaagttttatcaagaaaggaacattttcttctaaaaatgattagtacagctaaacaaaataaaaataataatcctatcgcacaaattaaaaataaaacctgagaagttttgatcaggcttgcctaaaacgagttgaaaccaaagccattttaagaatccaaaatatgagattagttttgttcaaaaagaattatccataaaagttaatagatgtttgcatagttaccataaaataagaggtaagcctttatgtatttttacttcataaagttgaatttctattaaaatctattacaagaaagggaaagtaactttccagtaatattcagattttttagtaatattgagcctacatttatgggacatcattttttaatgtttgtccactgaatattttaagttatgtttgtcataggaaattaaatttgcttaccattcttaac

SEQ ID NO: 464734 - DNA, 6644 bp, Homo sapiens
attgatagcggatagggctgtgtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacatctagttcagaaaacagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattaataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacaatccatttagagaaaactggaaaaggattatgtgctacaaaattgagtgccagttcagaggacatttctgagagactggccagcatttcagtaggaccttctagttcaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctcgacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtaataacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaagtaaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttatttttttttattttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaaatctctgggttaagaaaatttgggcttaaatgtatcctttgttattttaaatatattgagatattttaattaaaatttttaccccattgaaccgattttatagtatttgtacctattttggtgtttttgtctttataatgaagtaatagaaccaattctattgctccttaattctatttaaatgatattaataattttataaaatgggtgacagtcttcatgtcagaatccagaaaaatgttggggtattgtgctcatagaaatgccaatgattgcatttatgagctgatgtcaatttacttaataagatttctcaacatctatgtagacatactgagaggatgagggttgtaactagggtgaaatggagagaaaggataggaggagaaataaaaagatggggagatattgaaaaatctttggcagagagtggcatgacgatatttgtgcgttagaaagagcacccttgcagtaccttgaagaaagaattacatgggccagtacaaaaggcagagagaaagtcagaaggcaattgcagtatccagaacctaggtgaaggtagcatcatgggaatgaggaggaagagacaaatctgagcgatattaaacagcagaattgaaagattgtagaaatgatcttgggggaagggtatgc

SEQ ID NO: 464735 - DNA, 6878 bp, Homo sapiens
tctggaacatcactggtgatttcatagattaataggcgaggggtgaccaaacctcagtggaccccatggtcctggagcagtatgtggtggtagccaactaccagaagcaggagagttcggagatcagcctcagcgtggggcaggtggtggacatcatcgagaagaatgagtcagtctcatggaggtattggtctctgccccggccggtgggccgccgccggactctgggggacttgtatgccatcagctggcgtcaaggtgcctacctcggagttttcttccccctgccagagcagataacactgggggtgggagctgttctagctctgtgggacaccctgccagagtgcagcgatgagcaacccgccctgccgagcccaggccctccagggctactgtgggagggacgcagctgggggcagctctcagggaggaggcttccttttgtccccacagaggagaagtacacagtcatctacccgtacacagctcgggaccaggatgaaatgaacctggagagaggggctgtggtggaggtcatccagaaaaacctggaaggctggtggaagatcaggtaccagccgctgccccccacggttgctgggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccccggactcaacagctgcgtctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcgtctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacattttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccattcgacttctttccttttttttttttaaaataaaaaaagtgcttgactggtttcaagcttcatcatgaagatgcagtgtctatggattttatttggcaggagaaagggtacatagctttgtggcctgggatcttc

SEQ ID NO: 464736 - DNA, 7143 bp, Homo sapiens
tctggaacatcactggtgatttcatagattaataggcgaggggtgaccaaacctcagtggaccccatggtcctggagcagtatgtggtggtagccaactaccagaagcaggagagttcggagatcagcctcagcgtggggcaggtggtggacatcatcgagaagaatgagtcagtctcatggaggtattggtctctgccccggccggtgggccgccgccggactctgggggacttgtatgccatcagctggcgtcaaggtgcctacctcggagttttcttccccctgccagagcagataacactgggggtgggagctgttctagctctgtgggacaccctgccagagtgcagcgatgagcaacccgccctgccgagcccaggccctccagggctactgtgggagggacgcagctgggggcagctctcagggaggaggcttccttttgtccccacagaggagaagtacacagtcatctacccgtacacagctcgggaccaggatgaaatgaacctggagagaggggctgtggtggaggtcatccagaaaaacctggaaggctggtggaagatcaggtaccagccgctgccccccacggttgctgggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccccggactcaacagctgcgtctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcgtctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacattttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaagaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccattcgacttctttccttttttttttttaaaataaaaaaagtgcttgactggtttcaagcttcatcatgaagatgcagtgtctatggattttatttggcaggagaaagggtacatagctttgtggcctgggatcttc

SEQ ID NO: 464737 - DNA, 7491 bp, Homo sapiens
tctggaacatcactggtgatttcatagattaataggcgaggggtgaccaaacctcagtggaccccatggtcctggagcagtatgtggtggtagccaactaccagaagcaggagagttcggagatcagcctcagcgtggggcaggtggtggacatcatcgagaagaatgagtcagtctcatggaggtattggtctctgccccggccggtgggccgccgccggactctgggggacttgtatgccatcagctggcgtcaaggtgcctacctcggagttttcttccccctgccagagcagataacactgggggtgggagctgttctagctctgtgggacaccctgccagagtgcagcgatgagcaacccgccctgccgagcccaggccctccagggctactgtgggagggacgcagctgggggcagctctcagggaggaggcttccttttgtccccacagaggagaagtacacagtcatctacccgtacacagctcgggaccaggatgaaatgaacctggagagaggggctgtggtggaggtcatccagaaaaacctggaaggctggtggaagatcaggtaccagccgctgccccccacggttgctgggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccccggactcaacagctgcgtctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcgtctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacattttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccattcgacttctttccttttttttttttaaaataaaaaaagtgcttgactggtttcaagcttcatcatgaagatgcagtgtctatggattttatttggcaggagaaagggtacatagctttgtggcctgggatcttc

SEQ ID NO: 464738 - DNA, 2716 bp, Homo sapiens
tcagatctatgtccttctcatcaatgataataattcacacatattttatgtgcatggctgcattattctccataatcgtttttgattgtatagaccaggaagttgcattcatcgtgcgtcacaatcatttgggtgtcctgtgtccccaagccttcaaccacatcctttgccatgaagcctccggggtgtcctgtgtccccaagccctcaaccacctcctctgccatgaagccacaggtgtctgtttctagcaggaaggggtctgcttcaagtcaggccctttctggtcgaaggctacagaggcccatacaagatggctctggaaaaaagcacaggaatctcaggcaaggaatagcggcccctgctgctgggcaggcccagcagaaagttttgcctataattggtactaagaaaggaatcagtgcaagtgaagggtgctgagcggcaacggaagggctacagagtaggggtgacgaatggtcgcttcccgttaagaagctgtcaccttctgactcctctcctggtgtcatttgctgatttaaaaaaaaaaaaaagattttggaaaaagtaaggcctgggtcaccagatacacacctgccaggtgttcagatgctggtccttccctggccccttaagtgagccatgaaaaggacctggtgattcacccacagataacggaagaaagttctgttacctcttgatagcagcttttgtgtccaccccatttccccaggtgggccgagagcattggtagctaattgtaatcactccacacaattagagctgtgctgccccttcccctagccagtggacttcggtacccagagtgaagcctgcagcctgtgtcagacaccagcatgtgtaatgggaggaaacagcttccatgtccagagcgctggttccaagggcatcttcaggcactgaaattggcactgaataggcatggggaagtttcagtggaagtgaatggggagcactggggggacttactgaaagactttcagatacagggagtatttgacacagctcacctccaactggcctggttttattctgaattgtttggagcagaggaagggagagggaaaacataaagatcagggtaataggttctaggagctgacggagctgatggagctgaacagggtagggaccatggaaggtagagctattgcgcaaaaattaggcagcctctaggcaggcaggcacttggctggatccaagtggcagtgttaggtgctgtgggtgaatgcacacccacaagtatatgcacattccctgcctcctggaagctcacagttcagccagtgatacatgtatagaagtttgaagcagtaacattagatatgaggttgaattcatgctgaccggatttctgtggacttcgtggaggccctgaaggctttgtaggatctagaaaggcagaaacagatgtggtgggggataggttgaagagtcgtggatgactcactaagacattgaggtgggaaggtatgcagggactataccacactgtgtggaggagggggttcatggaaagggtaagaactcccaaagggtagatgaagagccatgaagacccagctaaggaaacccatgaatgactgggatccactggaaagtcttgagcaaagaaccggaggatgcaagtgctgcagagaacagaccccatactgtggacggattgagagcacagtgggggcccctcaagctgttccacactctgggcagtagggtttatccaagtgcccaccaccaagtatctgggcactaggcagggagcaaggggtgtttccagttccagtgttaaaaaattccatccaatttgtaggttccaaggaaggattgggctcccagaagcttggagttcttgttttatgaccaccatccagccctaagagcctggggggtttgtatgcattttcattgcgcagatggacctcccaattttctcaactttacttccctttcacatttgcacagaccatataatcatggttttaaaggtcataaagctgaggcatgagaatcacttcaacccaggaggcggaggttgcagtgagctgagatcatgccactgcagcctgggcgacacagtgagactatgtctcaaaaaaaaaaaaaaaaaagttgaacttttgcttctgggatgtttatgttttttcctagtcttcaggggttcagggctctcagatgtctcccccaccatacctccactcagtcttccactgatgacatttcttaataattcacgtgcttccccctcggctcagttacacattggagaacactgctgcatctgaaccactgtagctgacaagctatcatgcagctcacccaaacagcagcttgcaaggcctatccattctgaacatttggaatggaactcttctgatccttattttccacctagaacagtcataatggggcaatgggaatgtattgattgtcactgttttgcttgtataccttggactgtttctgcaaaaggagatatgtttgagtgttttaaggcagccttgcagatagcttctaaaaagaattcactggcctgaaaaaatgattcctagcctgcagaactttcatttgtcttccctgtgcttgagagagttgggtagcccacaggaaagaacaagtggtgaaaacctggcttctaatcctaaagcttccaacagcgagttatggggtcttgggcacattctttacatttcaggctc

SEQ ID NO: 464739 - DNA, 3259 bp, Homo sapiens
tcagatctatgtccttctcatcaatgataataattcacacatattttatgtgcatggctgcattattctccataatcgtttttgattgtatagaccaggaagttgcattcatcgtgcgtcacaatcatttgggtgtcctgtgtccccaagccttcaaccacatcctttgccatgaagcctccggggtgtcctgtgtccccaagccctcaaccacctcctctgccatgaagccacaggtgtctgtttctagcaggaaggggtctgcttcaagtcaggccctttctggtcgaaggctacagaggcccatacaagatggctctggaaaaaagcacaggaatctcaggcaaggaatagcggcccctgctgctgggcaggcccagcagaaagttttgcctataattggtactaagaaaggaatcagtgcaagtgaagggtgctgagcggcaacggaagggctacagagtaggggtgacgaatggtcgcttcccgttaagaagctgtcaccttctgactcctctcctggtgtcatttgctgatttaaaaaaaaaaaaaagattttggaaaaagtaaggcctgggtcaccagatacacacctgccaggtgttcagatgctggtccttccctggccccttaagtgagccatgaaaaggacctggtgattcacccacagataacggaagaaagttctgttacctcttgatagcagcttttgtgtccaccccatttccccaggtgggccgagagcattggtagctaattgtaatcactccacacaattagagctgtgctgccccttcccctagccagtggacttcggtacccagagtgaagcctgcagcctgtgtcagacaccagcatgtgtaatgggaggaaacagcttccatgtccagagcgctggttccaagggcatcttcaggcactgaaattggcactgaataggcatggggaagtttcagtggaagtgaatggggagcactggggggacttactgaaagactttcagatacagggagtatttgacacagctcacctccaactggcctggttttattctgaattgtttggagcagaggaagggagagggaaaacataaagatcagggtaataggttctaggagctgacggagctgatggagctgaacagggtagggaccatggaaggtagagctattgcgcaaaaattaggcagcctctaggcaggcaggcacttggctggatccaagtggcagtgttaggtgctgtgggtgaatgcacacccacaagtatatgcacattccctgcctcctggaagctcacagttcagccagtgatacatgtatagaagtttgaagcagtaacattagatatgaggttgaattcatgctgaccggatttctgtggacttcgtggaggccctgaaggctttgtaggatctagaaaggcagaaacagatgtggtgggggataggttgaagagtcgtggatgactcactaagacattgaggtgggaaggtatgcagggactataccacactgtgtggaggagggggttcatggaaagggtaagaactcccaaagggtagatgaagagccatgaagacccagctaaggaaacccatgaatgactgggatccactggaaagtcttgagcaaagaaccggaggatgcaagtgctgcagagaacagaccccatactgtggacggattgagagcacagtgggggcccctcaagctgttccacactctgggcagtagggtttatccaagtgcccaccaccaagtatctgggcactaggcagggagcaaggggtgtttccagttccagtgttaaaaaattccatccaatttgtaggttccaaggaaggattgggctcccagaagcttggagttcttgttttatgaccaccatccagccctaagagcctggggggtttgtatgcattttcattgcgcagatggacctcccaattttctcaactttacttccctttcacatttgcacagaccatataatcatggttttaaaggtcataaagttcactgtgctaggagatacagaaatactttcttgatgacggggccaaacgttcattaagtgctttcatgtgccctgcatttgaatttattcatgatagcttcaacattctgagtgtttactgtggggcaggcactgtgctaactgtgtattatcttgtatacttttcaggacaagtgaaagtgatgaccccatttaatagatgaagaaaactgacactcaaagaagggaaataacttgcccaagatcacagagctcaggttggctggactctaggacatcccatgcctccacaccatgctgcttgtcagcagcagcacgcagagctggttgcaaaggaggggctgacatatattaagagttgaggccgggcgtggtggctcacgcctgtaatcccaacactttgggatgccgaggtgggcggatcacaaagtcaagaggtcgagaccatcctgaccaacatggtgaagccccgtctctactaaaaatacaaaaattagctgggcgtggtggcgtgtgcctgtgatcgcagctacttgggaggctgaggcatgagaatcacttcaacccaggaggcggaggttgcagtgagctgagatcatgccactgcagcctgggcgacacagtgagactatgtctcaaaaaaaaaaaaaaaaaagttgaacttttgcttctgggatgtttatgttttttcctagtcttcaggggttcagggctctcagatgtctcccccaccatacctccactcagtcttccactgatgacatttcttaataattcacgtgcttccccctcggctcagttacacattggagaacactgctgcatctgaaccactgtagctgacaagctatcatgcagctcacccaaacagcagcttgcaaggcctatccattctgaacatttggaatggaactcttctgatccttattttccacctagaacagtcataatggggcaatgggaatgtattgattgtcactgttttgcttgtataccttggactgtttctgcaaaaggagatatgtttgagtgttttaaggcagccttgcagatagcttctaaaaagaattcactggcctgaaaaaatgattcctagcctgcagaactttcatttgtcttccctgtgcttgagagagttgggtagcccacaggaaagaacaagtggtgaaaacctggcttctaatcctaaagcttccaacagcgagttatggggtcttgggcacattctttacatttcaggctc

SEQ ID NO: 464740 - DNA, 2868 bp, Homo sapiens
ccgccgagtctggaaaccgcattttatcagtagtccagtcatattttgtttactgggcaaggattgaatcatctgttgtgtctcaacagacacatagcagcgcccattctgacgaccgcatggagcccagattgctgatgccaaaccttcaccagaggctgggcgatgttgaaggagctgctccagctcccaggacccccatcactcttccacagcagcacacacatgtctttgctgttgcccttcctggagctgcagaggaggacaacctagatcctgttcctgccagtatttgggtgacaaagtttcctggggatgcagagactctgtcccaaccatcttcacacacagccactgaaggcagcatcaaccagcaacccagcggggacagcaatcccaccctagagccgtccctggaggtccacaggctggagaggctcgtggccctcaagagagtctcctcagagagctttgcttccagccttagcacccatcacagaactcaggatgatcccagctttgattcactggaaacttgcctgtcctcagatgggggtgaacaggacaagacgaaggcctctaacaggaccgtgacacagcctcctctgtccaccgtccagcttacctatccccagtgcctctggtcctctgaaactttcacagggaatggggtcagggcaagcaacccaatccctgtcctccagacctctggcacttctgggctacctgctgctggtgaccagtcagaggcatccagggcctctgccagcttcttacctcagtcaaagcacaaggagctcagagcagggaagggaaatggagagggtggagtgggataccctcggcagaccaacccacggcctgacattgggctagagggagcccaggcccctctgggtatccagctcagaactcctcagctgggaattctgctttgcctgtcagccaccctgggcatggccctggccgctggccttcgctacctgcacacccagtattgccaccagcagacagaagtgtctttcagtgagcccgcttcggatgctgttgccaggagcaacagtgaaactcagggctccagcaaacagggattgaaaaccatgaacaacgccttcttcagatgaggagaacaaggccacggagagaccctctgggattggacataaactcctcttgatattaaacaaacaaatatttttttctttctctttgtaatgcttgttggtgaaacattttgcaggcctggttgtctgccaaacatggggctctatgccccagtggcagatgcatctagaggaagcataaagaatggagtaggggcaggagaaaggatggatcggggagtggaaatgagccataaaggaaactgaggacctgctgaacaggcaacagagaagtaattaaacgagaagggggaaagtcaaagacagctgattagtggcccagggtagttgaatgcaaaggttgagcatctttgaaatccagatcgctagacctcagttggcaagccaaaataaaagcacttggccagtaacacatgcacagcctaggatacaaccaacggctctcttccattgttctattcgacacacttccctgcacttatagttttaaaatatcgtacacataacattatgatttcagttctaaatgtaaaccatgatttctttttaaagacgtatggcagccttcatttccagtcaaggcatgcgacattttagggtcctgtggaagaaatgcgatatgctttcagatcacgtgtgaaggaggtctcactgagtttatatcactgagtcatgtgagtgacctcattacatcctggaaacagccctgtgtaggtgtcatcatcatcagccccattgtagagaaggacaccaagacccaggaaggaggagggattccaacagggtcccacagcactggcggtggggctggggctacaatcagttcacctctcctacatcacgttttactgagcatctgctgtgcgctggactcgcggctcggtgtgaacaggatgctgcgtcttgcatttcctcggaaacaggctctgtaaatgtcaaggcaagccctttggcttcccttggaactactcattcttgcagaagctcagctagaagaggaagctggagagcgcgaaggcagctgccacctcttgcacgcgtgggggtctcggggtagcaggggctgctctgtgctgggctgggccagtagggggcgccctccctgggagcagcagggccttccagaaggccagggcggtctccggcgctcagacctcagcctgcctctccgccccgcccctcttggggggcatcccttctgtgcacgcccacgtgtgagcagagaagcaactctcagaagccttctgtgtgttcaggaaatgcgaggcctggctggatttgaacccgtgacccagacgtaaaagggcctgatgtagggctccctttacaataactggctgcctgtaccttgttactcccagcccaggactctctctcacatctgcccatgctttctcctcatgcagctgaagtttggttagatcctgacttagcactggggctaagtgattgatgtccctgggcaagcagaagatgcattagtgtcttagggaatggaaaatgaaaggtggaagaagaacgggacggtgggactgcagtgtgattagcgtgtagccaaaagccatgtgctcctgtgaagccagggcctgaccctctcaggatctgtgcagcctgtcggccagccagacggctcccatgcaaaggccaccaggagtgtgggtctggagtaatactgagtttagattctccaggtgtcaactattctggtgttgaaattgtcatcattattcatactgatagtttt

SEQ ID NO: 464741 - DNA, 1259 bp, Homo sapiens
tgatgttacaatttttttatttcagcagttacatatattttaacaaacatataagtctatttggtttatccagagatttgccattttggttgctcttccttctttgcaatcattttccttccccatgaacttcctttaccatttctgttaaaggaggactactagcaatgaattattttagctttccttcttctgacaatgtctttatttcagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccactccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgatgtgcctgggtgtggttttcctttttgggatttgctgtgccagcagaccggctttaaatagaatgttatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaac

SEQ ID NO: 464742 - DNA, 1200 bp, Homo sapiens
acctgggcctccagcggatgctgccatggtgacgacgcccgccgtccgcgcaggcgcccaggctggcgcccctgctaaccgggcactggtggcagggaaattcgactccacaaaccacaggcctcggcgggggaagagcccggcgggcgccagcgaagcggaaccaaacggagccgcggcacgcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacagttgcagtgagctgagatcgcaccactccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgatgtgcctgggtgtggttttcctttttgggatttgctgtgccagcagaccggctttaaatagaatgttatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaac

SEQ ID NO: 464743 - DNA, 1515 bp, Homo sapiens
acctgggcctccagcggatgctgccatggtgacgacgcccgccgtccgcgcaggcgcccaggctggcgcccctgctaaccgggcactggtggcagggaaattcgactccacaaaccacaggcctcggcgggggaagagcccggcgggcgccagcgaagcggaaccaaacggagccgcggcacgcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacaagccgcatgttgaagtgtgaggcgtgaaagggtatgtctgatatttgctttaaaatgctccagcaaagaaattaagggatggatgaagcaaaagagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccactccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgatgtgcctgggtgtggttttcctttttgggatttgctgtgccagcagaccggctttaaatagaatgttatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaac

SEQ ID NO: 464744 - DNA, 1231 bp, Homo sapiens
acctgggcctccagcggatgctgccatggtgacgacgcccgccgtccgcgcaggcgcccaggctggcgcccctgctaaccgggcactggtggcagggaaattcgactccacaaaccacaggcctcggcgggggaagagcccggcgggcgccagcgaagcggaaccaaacggagccgcggcacgcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacaatgaagtctcactctgttcccccaggctggagttgcagtgagctgagatcgcaccactccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgatgtgcctgggtgtggttttcctttttgggatttgctgtgccagcagaccggctttaaatagaatgttatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaac

SEQ ID NO: 464745 - DNA, 1386 bp, Homo sapiens
caataggcttgcacatttgaaaacttctggtctgatgtccaagtttttctaaaatggtactgcacagaaggagcagttttactgagacaataggagctttgggtacctgtgtgaatgtggtcacaccaagttactgcttcaaagaacaagaaacgaatgctgtgagaactgcagagaccacagcctatagtggtattccccaaatgggcctgatcagaagactcatttgggggcagttgtttaataatttagattcccaggcttgtgaaagcaagaagggaggctacccttcagacagagtggccaggttttggggcacacgggagaggcaagtgaggcccaggccctttaagactctggagtctgtggatgtggccaaccaatgcctggctggacccaaaaaccccacgacctcagggtcaagggctagggcactggtgagagctctcactcggaatttcctgctggagtgctagacctgcagcacataaatatactttacttttctttcttctcccatttccttagttttgtttgtggaacagtattggagccttcccaggcattgtttcattctgacaccataacaaggtctgctccctattcactttctcagtcagaagcctgtggagtgttcattgttcctgtggatttttactgatgcacaattgtgtttaaaataacttgtccgaaaaccacagtgctaggctcagcagagtctcatcttgataaacttctgtgagaacaaaggcatggggacacactgaattttccttttctgagcttgaaaccagctgatcatgcttcctgtttctctaagggcttccctgacatagacgacttgcttctttcaaatttggtcatcgccctcttgccttcctgtgtgagtcagcgtggctgcccttgtgcacgccaggctcctgtctgtgctccggggcctgtttcctggcctccccagatgaggaaactgaggcacaaaaaggtgaagtcctgagctcacagtcatgcaaccagcaggtggtgaaacacacctccaagctgcctgcctcctaagcatcaagctttgtggcccaggatctacttcatgctccaaatattcatggaccttcccaggacctcaacaaaacaaaaccatgaagaaaaaccttgacatgaaccccaaaaaaacccagtcagcaatattttaagttaaattttgaaacaaatccaaacgggttcctccccataaatctaccagtaaattgtgcagaatcagaactgaagccatgccctttcttaaagtattgaattagaataaatgagaacatctaaatattttccaaattcatattccagttataatattcaagtttcttagtttctctctgttcacattcaacatgaaat

SEQ ID NO: 464746 - DNA, 1394 bp, Homo sapiens
  misc_feature (1385)..(1385): n is a, c, g, or t
caataggcttgcacatttgaaaacttctggtctgatgtccaagtttttctaaaatggtactgcacagaaggagcagttttactgagacaataggagctttgggtacctgtgtgaatgtggtcacaccaagttactgcttcaaagaacaagaaacgaatgctgtgagaactgcagagaccacagcctatagtggtattccccaaatgggcctgatcagaagactcatttgggggcagttgtttaataatttagattcccaggcttgtgaaagcaagaagggaggctacccttcagacagagtggccaggttttggggcacacgggagaggcaagtgaggcccaggccctttaagactctggagtctgtggatgtggccaaccaatgcctggctggacccaaaaaccccacgacctcagggtcaagggctagggcactggtgagagctctcactcggaatttcctgctggagtgctagacctgcagcacataaatatactttacttttctttcttctcccatttccttagttttgtttgtggaacagtattggagccttcccaggcattgtttcattctgacaccataacaaggtctgctccctattcactttctcagtcagaagcctgtggagtgttcattgttcctgtggatttttactgatgcacaattgtgtttaaaataacttgtccgaaaaccacagtgctaggctcagcagagtctcatcttgataaacttctgtgagaacaaaggcatggggacacactgaattttccttttctgagcttgaaaccagctgatcatgcttcctgtttctctaagggcttccctgacatagacgacttgcttctttcaaatttggtcatcgccctcttgccttcctgtgtgagtcagcgtggctgcccttgtgcacgccaggctcctgtctgtgctccggggcctgtttcctggcctccccagatgaggaaactgaggcacaaaaaggtgaagtcctgagctcacagtcatgcaaccagcaggtggtgaaacacacctccaagctgcctgcctcctaagcatcaagctttgtggcccaggatctacttcatgctccaaatattcatggaccttcccaggacctcaacaaaacaaaaccatgaagaaaaaccttgacatgaaccccaaaaaaacccagtcagcaatattttaagttaaattttgaaacaaatccaaacgggttcctccccataaatctaccagtaaattgtgcagaatcagaactgaagccatgccctttcttaaagtattgaattagaataaatgagaacatctaaatattttccaaatcgtcgaaggtacgagaggaaataaaataatagtcgagggcggccggtgtagaggatctttngattacgta

SEQ ID NO: 464747 - DNA, 713 bp, Homo sapiens
cagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctttgcaccgcccacgccaagtaccttgcaaggcggctgctaagcctggctaattttagatctccagaatgcgctatgcccgcgctcaactaaaaccaagtcaaaccatcaagcacagtgatgtgctgctttttgaacaaatatggctcaaaactccgtatttccctgaataaagtcgattatctgcactttttaaaagccctaccccctgtggtctggcagttggctgaaaagcggaaagccacacgctcccacctcaaacatggtcatcacctttctaaggaacaaaagtataatgactcagtattgtatggttgcatagacaagggctcggaacaagagacactagttttgtctgacggtcgtgggaatcggagcgtcctgccgttcacatctcctgcattccgtttagcggaatcaattaggcaagacagaccctcagattccccaccccctttccatttttgtcaggtctatatacgtcctaattatttcagtttgggatgccagagctgtttcctggatagacctgatcatccttaaacaaaaagagaggaggcgcacacgtgggttgtggc

SEQ ID NO: 464748 - DNA, 1716 bp, Homo sapiens
tgcaagtatctgagtctgggtcaggcccgaaatggcagaggagaggagctttgaagcacatgagaaactgaatcagcctctaactgaacgttgcatggcccatgggcctgtcccagaggctagatacctgaaggctcgatactgcctgctgcttgaggctgggctaggggcaacatgccacagttgggctggagtggaactcagtgacatctttgagaccctcagctgggctggctgggacagttggggctcttctccacatagtctcccatcctctgatcggtcaacccgggctcattcatgtagtgatgggagggctccatggaagcagcaagagagggcaagccctaaggagcgagtgtttctccaggcctctgcatgcattgcatgtgctgatgtcccattggcagccatagtcattcacacggccaagcccagactcaatgtgggaaggggctacttgcagactgagggcgtgaatcactggtggccattactacaaaagtagacaatcgcctttcctgttaattccaattattcacagtcctttcacatgcaaaaatgtactgattcccgccaggacccccatcaattgcattcaattatagcatcaattatggcaaagtctaggatcctgtgatttctgtcaagtccaaatgaggaaactgggctttaaaggtgcttctgagctatggacccagattaactacccagcaaactgaagttatatttggggtacttttctggttgctgccttatttgtgtatattgcagcttattgtgtatagcaaccttgagatactgaagagactggggtacatgggaaaaaaggcagaaaggacacagtggaaaaaccaactcacataggatgaaatgtgatggggtgaaatcatggcagtgtgattttcaaacaccaacttgccttggaagggaatgtggggatgtgcactgctggaagccatgtgttctgatatgagaagaacttcttcagaaggtatcttaatgcatatggggaaactgaggcccagattgcacatacatgagttgccctggaaaatcccaagtcaaagaagctgcactgcaggaaatcagtatggtgcaggccccaggcaaggcatcactgactacacttgcaagaaacaaacgcctgcaaaaatcaggacaggatgattttgaagctgtgcaaaacagttgtcatagccttctccagcatgtgttccttctgtatttcagacatggcagaggagacacagcaataactaaggggcaactattgcatccagaaaaaaaaaaaatgaagataatgacttctctgcaactaagatgaagatccactgaactttggggtttgaaatgcaacgttagaacttcagactcccggcacctaggtctccagctgctgggtggtgccagcatcagagatacactctgcaaaacatatactgtcttaggaaaaagtgaccctgttgtcctttcaggcccatattccacaagaagacaaatggagatgtaaaaggaaaactgcagctccgactgaagagagagcaagttgtctgttctgatacagccaggaaataagatgttctggttaatatgtgctaaagatgtggtgctgactttccgactcagaatatgatcacatgtttttctcattaaaactatattgaatattatttgaccattgttgagtcagtcatcttgataaatattatcttc

SEQ ID NO: 464749 - DNA, 998 bp, Homo sapiens
attccggctcagcgcctggcgagtcctccgcttgtactgagacgcctgggatctcaaaatggcggccccgtgcggaaacagcgtctgggagcagtcatgttgcctcctgaacaaagccgctgaagatgaagaatgggcaaaatcgccccatacggaacagcgcagcctcgggagcccgttacctggctcgcgaacacgaagcgggagagttcgccaatatggatgtgacagcggttcccattaagcggtgataggatttttgggacctgataatcaagctagggaccctgggatggcacaaatgaaacaatctctctatcatgatattcccccgttgctctgaatgagttcagctctgtctgcatgatctatcccagactgaaaagagtttaccagctaagtactttcctgcaatgtagtatattcccgtttattgttccaacctgtcagtaattttttatacaggcaactgccttgttgaaaatcagcaataaaaatttaaaccaaagaaatcttaaaatcagcaataaaaatttaaaccaaagaaatcttaaaatcagcaattttaatccacaaatattgatttatcaagagaatttgctggtttggagtaaaatataaaagagcttgtcttactcagtttgggctgctgtaacagaatgccacagatggaggaccttaaacagcaaacatttatttctcacatttctggaggcagagaagttcaagatcaaggtgccagcaggtctagtgtttgctgatagcactcttcctgttttgtaaacttctcattgtatcctcacaaggccaagagacaaatcatctctctgatatttcctgttgtaagggcattaatcccatttattagggctctcatttcatgacctaattacctcccaaagaccccacttcccaatacaatcacattagaattgcaacatttgaattttggagggacaaacattcagtccataacagagctcttagaattttgtagg

SEQ ID NO: 464750 - DNA, 918 bp, Homo sapiens
agatatcagagcattctaaggcatattctctttcttattatgaaaggtgtagtttcagtcttgcttattcgtaagtttactgaaatagtttatgttctatttaacaaatatttattggacatctgctatttactctatggagggctgggtgttcagacattaacatgactatttgattgtttccttcctgatttattttgacaaaccctgggatggcacaaatgaaacaatctctctatcatgatattcccccgttgctctgaatgagttcagctctgtctgcatgatctatcccagactgaaaagagtttaccagctaagtactttcctgcaatgtagtatattcccgtttattgttccaacctgtcagtaattttttatacaggcaactgccttgttgaaaatcagcaataaaaatttaaaccaaagaaatcttaaaatcagcaataaaaatttaaaccaaagaaatcttaaaatcagcaattttaatccacaaatattgatttatcaagagaatttgctggtttggagtaaaatataaaagagcttgtcttactcagtttgggctgctgtaacagaatgccacagatggaggaccttaaacagcaaacatttatttctcacatttctggaggcagagaagttcaagatcaaggtgccagcaggtctagtgtttgctgatagcactcttcctgttttgtaaacttctcattgtatcctcacaaggccaagagacaaatcatctctctgatatttcctgttgtaagggcattaatcccatttattagggctctcatttcatgacctaattacctcccaaagaccccacttcccaatacaatcacattagaattgcaacatttgaattttggagggacaaacattcagtccataacagagctcttagaattttgtagg

SEQ ID NO: 464751 - DNA, 398 bp, Homo sapiens
attccggctcagcgcctggcgagtcctccgcttgtactgagacgcctgggatctcaaaatggcggccccgtgcggaaacagcgtctgggagcagtcatgttgcctcctgaacaaagccgctgaagatgaagaatgggcaaaatcgccccatacggaacagcgcagcctcgggagcccgttacctggctcgcgaacacgaagcgggagagttcgccaatatggatgtgacagcggttcccattaagcggtgataggatttttgggacctgataatcaagctaggggtcacagactactctcaagttgaaaaccttcagaagttttctcaaaccacttgtcccctccataactcgtgccttcacagaagaaaacatccttcaaataaatatcaaaacaaa

SEQ ID NO: 464752 - DNA, 575 bp, Homo sapiens
actgagacgcctgggatctcaaaatggcggccccgtgcggaaacagcgtctgggagcagtcatgttgcctcctgaacaaagccgctgaagatgaagaatgggcaaaatcgccccatacggaacagcgcagcctcgggagcccgttacctggctcgcgaacacgaagcgggagagttcgccaatatggatgtgacagcggttcccattaagcggtgataggatttttgggacctgataatcaagctaggggtcagcaggggggtttatgggttgagtctgggattggtattggggcagggttccttggggttcagtgacgaggtctatgagttcagtgatggttagtgatgagtgttgggaacatgtgggggtcattagcagggaggcctgtgtgatctgtgggtcagggatggagtgtctgcgccaagtgatggggtgtacgtgtggccagtgacttatggacctgtatgactggtgctatgatggtggtggggatggatgtgttctgtggggtttgtgatttctggacctggcgattcagtgattttaaggaccaagggctgttaaagttagtt

SEQ ID NO: 464753 - DNA, 1720 bp, Homo sapiens
attccggctcagcgcctggcgagtcctccgcttgtactgagacgcctgggatctcaaaatggcggccccgtgcggaaacagcgtctgggagcagtcatgttgcctcctgaacaaagccgctgaagatgaagaatgggcaaaatcgccccatacggaacagcgcagcctcgggagcccgttacctggctcgcgaacacgaagcgggagagttcgccaatatggatgtgacagcggttcccattaagcggtgataggatttttgggacctgataatcaagctagggacctgattcctcagacctctgccctatcggaagggaagcagaaaatgatcaggtctcagggtccagtgtcatttgaggatgtggctgtggatttcacccaggaggagtggcagcaactggactatgctcagaggaccctgtacagggatgtgatgctggagatctatagccacctggtctcaatgggatatccagtttccaaaccagatgtcatctccaagttggaacaaggagaagagccatggatcataaagagacacataccaaattggatctatccaggtgaaaatgtggcagatgggagacaagaaaaataaatgctcagttgctttattttatttttaactggcttatggctgaggcttagatctccacccagattgccatctcctatttcttcttgctcctgtggagagcatgtagtaggcattcaacaactaactcattaatagtgagccatgtacaaaaagagcaataaacaatctcttattcattatgtgaatgttgaaactggggagaagacctatgtatgtgttgaatgtggaaaatcctttctcaagaagtcacagattattatacatcaaagaattcatactggagagaaaccttatgattgtggtgcatgtggaaaagccttcagtgagaagtcacaccttattgcacatcagagaactcatactggggagaaaccttatgattgttctgaatgtggaaaaggcttttctcagaaatcatccctcattatacatcagagagttcacactggggaaaaaccatatgaatgtagtgaatgtgagaaagccttctcccagaaatcacccctcattatacatcagagaatacatactggggaaaagccctatgaatgtagagtgtgggaaagccttttcccagagtcacagctgattatacatcacagagctcatactggagagaagccatttcacactggtgagaaaccctacaaatgtgctcaatgtgaggaagccttcagcaggaagtcagaactcattatacatcagataattcatactggggagaaaccgtatgaatgtacagaatgtgggaaaacattctctcgcaagtcacaactcatcatacatcagagaacccacactggagagaaaccctataaatgtaccaaatgtggaaaatccttctgtcagcagtcacatctcattggacatcagagaattcacacgggagaacaaccttataagtcagaccttgttgtacatcagataattcatactggagagaaacctgatcgatgtactaaagagacactcatttataaatattccatgccaggtaaggatggcacataagtaatttccagttggtgaaacttcaacagacatgaggaggaaaacctatcacaaggttcctatctatgtagaatttagacaaacaagggggagggaggatgggctaag

SEQ ID NO: 464754 - DNA, 1181 bp, Homo sapiens
cagaatgcttaagaattcattttcatataaattctaccaaagaatcaaaggaaacctaagcagattttaaaacatcacatctaccatacccatattctcactctgctggtacagcatgcagcattaaaccaataacactgaccactagggttgccatatgtgggacatacttatgctagggaaagaaagtatgtattattcatctgaaatttaagattaactgggggttctgtattttgtctaaaaaccctggtaacaacgcagttccttgaaatataatagtggtcaagttaaataactgttaatatttcttctgttttctctgccttaggatgaagtattcatttgtgatgagcagtgtgcaaacaataataaagccaaatccacatttttgtgacactcctgacaaactgctgctgtattaaagaaataaattacaagtcctctattgctccactgcacagctctcatccctatttttgaggcatttcaatcaaccttgcaattttcaccaagtagtaagatattaaacatatattttatctgccctgaaatagcattgattttgaaactgtgagatcttctaattttttttccagataatggtcaaactggccctttgggttataaattaggtttttcatggctaatatacttcacatcggcacatattatacaagcaaaaattatgtcatcaaaaggctctggtacaatatgaagggagcataaatgtcaagattgatgatgacggctcggagccagctcattaaaggcaatggtgtgaataatataactatgttgcttttgaaagaaccgaatatgtattatccacctatcagtgcaccaaagcagcgtcataaacatagatctctaactgcagcccatttaaatgatgaaagggtatatattaatctatgaaatagattttacccaggggggaaaattgttctatttatgaaagttaaaaacattcagtgcacagagaagcacttatcagatgagcatccacggtatgcagatgcattttactaatgcttcctgctaagataaatagtctgtggtcatggaagatgctactataatttgctagaaataaaagaactaaaaagaacaacatgtaggcagctttttgtaaagcatggggagtaaatattctaaattactggacctctgtgttttat

SEQ ID NO: 464755 - DNA, 1345 bp, Homo sapiens
tgcttccaaccatctgagtaacaagtcaatatgactattttctggtaaaactgggaatgcttacagacgccaggggtgaaaggcattcaacaatgacttattttaaggatgaatttgtaaactgccagataaagggcgagagattgccaggatggtatcctacccacctgccaccttattgcaacggccctgagttgcagacacttgtcacttatgtgccctggactgtgtgtaagaactgtgttcccaatgcacagtcaacacaaagtcctctgtggttcactggaaccaccaccagcaccatcaccatcactagaaacaaacagattcaaaagctagcaaataacatacctcccagcagtcctctgaccacaccatacctgagcacatttactgtggacagcatgtttagcttgaagtctttccttctaccccatcatagctaccactgttgtgagaactcccatgtccagcactccagggaggtgacatcaggatgaagtattcatttgtgatgagcagtgtgcaaacaataataaagccaaatccacatttttgtgacactcctgacaaactgctgctgtattaaagaaataaattacaagtcctctattgctccactgcacagctctcatccctatttttgaggcatttcaatcaaccttgcaattttcaccaagtagtaagatattaaacatatattttatctgccctgaaatagcattgattttgaaactgtgagatcttctaattttttttccagataatggtcaaactggccctttgggttataaattaggtttttcatggctaatatacttcacatcggcacatattatacaagcaaaaattatgtcatcaaaaggctctggtacaatatgaagggagcataaatgtcaagattgatgatgacggctcggagccagctcattaaaggcaatggtgtgaataatataactatgttgcttttgaaagaaccgaatatgtattatccacctatcagtgcaccaaagcagcgtcataaacatagatctctaactgcagcccatttaaatgatgaaagggtatatattaatctatgaaatagattttacccaggggggaaaattgttctatttatgaaagttaaaaacattcagtgcacagagaagcacttatcagatgagcatccacggtatgcagatgcattttactaatgcttcctgctaagataaatagtctgtggtcatggaagatgctactataatttgctagaaataaaagaactaaaaagaacaacatgtaggcagctttttgtaaagcatggggagtaaatattctaaattactggacctctgtgttttat

SEQ ID NO: 464756 - DNA, 2785 bp, Homo sapiens
cagtgggagggtgtttgcagctctgccaaggaatattaatcagaggcaatgcatagggtttctaggttgattggtgtcgcattcttgggcattgggtgggtggatatctgtgtggtacctaatacactggagcccactggcaacaatgctcagacatggccttcccagctcctccaggggcccctccttccactaggttctccatccatctttcctggattcatgggagctgtcatttcctactctttgctggaaagggaacagtccactctctttctcttcggacaccaagaggaggggtgcctgtatctggatgggctggcctggcaggaagccctgggcacactagtggacccatgtttgtttcggtttgctgatggcactcctccttcttcctatgtcattttcccaggatttaagctgttctttggctgcaaatgtacctttggaagacgcacagtggggtctccaggcacagaaagtaaaccagctggaacagaatatgctggtagcctggaccgtgttgagtttcttggtgttctggtctttaagggagcagctgctatcctgcagttggggctggagtacatgatgagcagttgttatttgtcagtgtagtttgtctggaaatgaatgctgatgttaggcaacttaatcccttccttgtgacttttgctcctatttccaagctgggtatctcttacacaggcattaacaagtaggttgactgtcgggacaagcccagggatggcattgtttctatttgctgataaatgactctggggctgtgaagactcagacccaaggagtgactcagaaagtcaggggcccatgtcattctgctctgggttcagacgtgcactgcagcagcaccgggacttgacagccctacggctcgatcagctttctgttttcattgccttacgatgccatgagtggaactattgtcaaatcagagttcactccccagcttttcagtctttcccctaattcttgctctatcagaggtcgaggacaacagtataatgattcataggttctacttcctggcaagtaatcattttcccacgggcccttgtgaattgatgaatatgaagacactaagaaagcagaaatagaactgagaagaatgaaataactgtctctacctttctcgaattgtctaatatggaaagaatgaaagacagctaataagcaactctctgcaagaagacatatggcttaggttctgctgagctattggtgatttgattccatgcatatgtattcactactgagatgggatcttgctatgtggcccaggctggcctcaaactcctggcctcaagatatttccccctgccttggcctctcaaagtgaccactctttttcttatcttactcagaatctacttggagagagtcaaacacagaatccctttgaatttaatggccattccaggtgatttgaacagccaaataagaaacaggtcctcttcaatgtacaatctgccaagtatgaagtctgaatgaccatcattattatgtatttaatgtgcatagaaaatctatctgcaaccttccagagtgtaccagaagtttggaatgtacattattattggctccatctcaaaccactcataaatcaaagaaaatagcagttccagaggaatcatcatagaggcttctaggcccccatgctgtgtgaacctggtgagaaagggaagtctgctctcactggacactggaactgtttgtctctgtctctgctgtactttccctgcctctacctcacttagtaaagaaatcatctttgcttgataactaaaacaaccaataaggctgagaaaggggaaaacccacatctggatttaaatacaaggtatgtttttgactttgtcagaaactgctaaactgcttttcaaagtagttgtaccattttacactctcacaggcaacgcatgaaaattcccttggcaacgtttgatattgccaatctttaattttagttattctagtgggtatagagtaatatcacattggttttaatttatattcccaaaatgactaatgtttaacatcttggatattcacatgtctttgtgaagagtctactaaaatcttttgcccttttaaataaattgtattaattgccttcctattgagttggagatatgctttatgtattctggatatactcctgtatccattaaggtgttgcaaatattttcttccagtccgctttttcatttaaaaaaatttttttttgaagacagcagaaggatttactgttgaaaaagtccaatttaagcactttaaaatttttaattaaaaaattatttttagtgatttttccttttttatctaaaaaatctttgcctaccacagggtcatcatacatgtttgaatctatttcagaactttctattctattccaccatcttgattgctatagcttcacagttaagttttaaaatcgagtagtgtaagttatctttctaaacattgtttttcccccttagattcttttctttttcatgtataatttaaaataagcttgtgaatttctttaaaaaaaagcttgccaggattttgattgggattacatcaaatctgtagattaatttgctaagaatggagaacaatactgagtcttccaatccataaacatagtattatctccatttttcaattctttaaaaatttccctagcaatgtcttacagatttctgtgtaaaagtcttgcatattttttgtctaaatttatttctaaatttctatgtcttctgagacctttgtacctggc

SEQ ID NO: 464757 - DNA, 1616 bp, Homo sapiens
ggagttaggaacagactataagaaatggttggtctggaggaaaaagggtaaaacttatgagggcccttgtgaattgatgaatatgaagacactaagaaagcagaaatagaactgagaagaatgaaataactgtctctacctttctcgaattgtctaatatggaaagaatgaaagacagctaataagcaactctctgcaagaagacatatggcttagaatctacttggagagagtcaaacacagaatccctttgaatttaatggccattccaggtgatttgaacagccaaataagaaacaggtcctcttcaatgtacaatctgccaagtatgaagtctgaatgaccatcattattatgtatttaatgtgcatagaaaatctatctgcaaccttccagagtgtaccagaagtttggaatgtacattattattggctccatctcaaaccactcataaatcaaagaaaatagcagttccagaggaatcatcatagaggcttctaggcccccatgctgtgtgaacctggtgagaaagggaagtctgctctcactggacactggaactgtttgtctctgtctctgctgtactttccctgcctctacctcacttagtaaagaaatcatctttgcttgataactaaaacaaccaataaggctgagaaaggggaaaacccacatctggatttaaatacaaggtatgtttttgactttgtcagaaactgctaaactgcttttcaaagtagttgtaccattttacactctcacaggcaacgcatgaaaattcccttggcaacgtttgatattgccaatctttaattttagttattctagtgggtatagagtaatatcacattggttttaatttatattcccaaaatgactaatgtttaacatcttggatattcacatgtctttgtgaagagtctactaaaatcttttgcccttttaaataaattgtattaattgccttcctattgagttggagatatgctttatgtattctggatatactcctgtatccattaaggtgttgcaaatattttcttccagtccgctttttcatttaaaaaaatttttttttgaagacagcagaaggatttactgttgaaaaagtccaatttaagcactttaaaatttttaattaaaaaattatttttagtgatttttccttttttatctaaaaaatctttgcctaccacagggtcatcatacatgtttgaatctatttcagaactttctattctattccaccatcttgattgctatagcttcacagttaagttttaaaatcgagtagtgtaagttatctttctaaacattgtttttcccccttagattcttttctttttcatgtataatttaaaataagcttgtgaatttctttaaaaaaaagcttgccaggattttgattgggattacatcaaatctgtagattaatttgctaagaatggagaacaatactgagtcttccaatccataaacatagtattatctccatttttcaattctttaaaaatttccctagcaatgtcttacagatttctgtgtaaaagtcttgcatattttttgtctaaatttatttctaaatttctatgtcttctgagacctttgtacctggc

SEQ ID NO: 464758 - DNA, 1690 bp, Homo sapiens
tttttttgagacaagctctatcacccaggctggagtataatgtcacgatcatagctcactataaacttaaactccagggttcagccgtggaacacaggtgatcttcttgactcagccttttgagtagctgggactacaggcccaccacactgtctaattttttatttatttatttttgtagagatgggatcttgctatgtggcccaggctggcctcaaactcctggcctcaagatatttccccctgccttggcctctcaaagtgaccactctttttcttatcttactcagaatctacttggagagagtcaaacacagaatccctttgaatttaatggccattccaggtgatttgaacagccaaataagaaacaggtcctcttcaatgtacaatctgccaagtatgaagtctgaatgaccatcattattatgtatttaatgtgcatagaaaatctatctgcaaccttccagagtgtaccagaagtttggaatgtacattattattggctccatctcaaaccactcataaatcaaagaaaatagcagttccagaggaatcatcatagaggcttctaggcccccatgctgtgtgaacctggtgagaaagggaagtctgctctcactggacactggaactgtttgtctctgtctctgctgtactttccctgcctctacctcacttagtaaagaaatcatctttgcttgataactaaaacaaccaataaggctgagaaaggggaaaacccacatctggatttaaatacaaggtatgtttttgactttgtcagaaactgctaaactgcttttcaaagtagttgtaccattttacactctcacaggcaacgcatgaaaattcccttggcaacgtttgatattgccaatctttaattttagttattctagtgggtatagagtaatatcacattggttttaatttatattcccaaaatgactaatgtttaacatcttggatattcacatgtctttgtgaagagtctactaaaatcttttgcccttttaaataaattgtattaattgccttcctattgagttggagatatgctttatgtattctggatatactcctgtatccattaaggtgttgcaaatattttcttccagtccgctttttcatttaaaaaaatttttttttgaagacagcagaaggatttactgttgaaaaagtccaatttaagcactttaaaatttttaattaaaaaattatttttagtgatttttccttttttatctaaaaaatctttgcctaccacagggtcatcatacatgtttgaatctatttcagaactttctattctattccaccatcttgattgctatagcttcacagttaagttttaaaatcgagtagtgtaagttatctttctaaacattgtttttcccccttagattcttttctttttcatgtataatttaaaataagcttgtgaatttctttaaaaaaaagcttgccaggattttgattgggattacatcaaatctgtagattaatttgctaagaatggagaacaatactgagtcttccaatccataaacatagtattatctccatttttcaattctttaaaaatttccctagcaatgtcttacagatttctgtgtaaaagtcttgcatattttttgtctaaatttatttctaaatttctatgtcttctgagacctttgtacctggc

SEQ ID NO: 464759 - DNA, 1993 bp, Homo sapiens
gtgtctccaaacagctttatgccatgaaatctgctgactctggctctgcctctgcccttccagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcaggacacccaggaatgcaaaagtaagtgcatccaaaaatcgagccgactttgacaagattgtgacaaaggacggcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacggcaccctgtgggcaacagagaaccatgggagaagacagaggctaatcagccctcacctggtacagtctcacctccaaaccttcactcttgctgcttgctctgcttaaaataccttctctacctaatctaccacatcacatccacctgcaaggcccagtgtcagggccccctcttccacgtagcctgatctccccagcagaaaccattgtcacccacctctgagtcactacaccctctgatcctccattagagttgatgccactgaatgccttgttgtcattatctccatttttagaacatcttaggaattagacctcaatatgaggcagtaaattatacgggatgggacggtatctctctcccttttcttagcttagctccttttaataaacataagaatctcacaccttacataatttttgaaatttccatttttttattttttaaacataaaataatattatgatattaaacatgcttttttccaactaaaccgcttctccatgctgacattctgatggtgctttcagcatggagtcaagggcaccaatcattagaggagaccttcagagaagggacatgtccaacccagatatgttagta

SEQ ID NO: 464760 - DNA, 1989 bp, Homo sapiens
gagaggatcccctgtttaaagcacaccctcctgtgctgattacaaggattatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcaggacacccaggaatgcaaaagtaagtgcatccaaaaatcgagccgactttgacaagattgtgacaaaggacggcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacggcaccctgtgggcaacagagaaccatgggagaagacagaggctaatcagccctcacctggtacagtctcacctccaaaccttcactcttgctgcttgctctgcttaaaataccttctctacctaatctaccacatcacatccacctgcaaggcccagtgtcagggccccctcttccacgtagcctgatctccccagcagaaaccattgtcacccacctctgagtcactacaccctctgatcctccattagagttgatgccactgaatgccttgttgtcattatctccatttttagaacatcttaggaattagacctcaatatgaggcagtaaattatacgggatgggacggtatctctctcccttttcttagcttagctccttttaataaacataagaatctcacaccttacataatttttgaaatttccatttttttattttttaaacataaaataatattatgatattaaacatgcttttttccaactaaaccgcttctccatgctgacattctgatggtgctttcagcatggagtcaagggcaccaatcattagaggagaccttcagagaagggacatgtccaacccagatatgttagta

SEQ ID NO: 464761 - DNA, 579 bp, Homo sapiens
aatgagggccgagtagatgtaggcgagctcggagagggaggccatggcacgggtgtgtgtggggctggcgctgctggatgaggtgctaatcgccggatgaagaatggcttcagggaaagatacttgtcctactttgcctaaactcactaacaactgctctgatgagagtctctataaatctgctaataagtatgaagagattcatttgccacgattttcattaaagcaagggatgatcccaagacgttatgtcatgccttggaaagaaaacatgatattcaggaatgtgaatctgaagcaagcagaagtgtgtgggatccatactggccctttagaagactctctgtttttgaatcacagtgaaaggctttgccatggggaagatcgtaaagttgtcttccaaaaaggcccaccagaaataaaaattgcagatatgcctttgcattcgcctctctccagataccaaagcactgtgatttcccatggcttcaggaggcgactagtctaatgaaagaagaataaaataataaagtgtttcaatctctgctctcttactgtctctgataaatgtttaagttc

SEQ ID NO: 464762 - DNA, 517 bp, Homo sapiens
aatgagggccgagtagatgtaggcgagctcggagagggaggccatggcacgggtgtgtgtggggctggcgctgctggatgaggtgctaatcgccggatgaagaatggcttcagggaaagatacttgtcctactttgcctaaactcactaacaactgctctgatgagagtctctataaatctgctaataagtatgaagagattcatttgccacgattttcattaaagcaagggatgatcccaagacgttatgtcatgccttggaaagaaaacatgatattcaggaatgtgaatctgaagtgaaaggctttgccatggggaagatcgtaaagttgtcttccaaaaaggcccaccagaaataaaaattgcagatatgcctttgcattcgcctctctccagataccaaagcactgtgatttcccatggcttcaggaggcgactagtctaatgaaagaagaataaaataataaagtgtttcaatctctgctctcttactgtctctgataaatgtttaagttc

SEQ ID NO: 464763 - DNA, 2389 bp, Homo sapiens
tctgttaggctttatgagttaattatgaaaacatacacgtgtttttcaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacaaccacggttggcttcccccagaatggattgtcttctggtatttgaggtgcaaacctgggaaccactggaataaccaaccctgcacctgagctccaaccaaatgttaggaactcaccaaccctgctcctgagctccaaccaaatgttaggaactcaccaaccctctacctgagctccaaccaaatgttaggaactcaccaaccctctacctgagctccaaccaaatgttaggaactcaccacccctgtacctgagctccaaccaaatgttaggaactcaccaaccctgtacctgagctccaaccagatgttaggaactcaccacccctgtacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgctcctgagctccaaccaaatgttaggaactcaccaaccctgtacctgagctccaaccaaatgttaggaactcaccaaccctgtacctgagctccaaccagatgttaggaactcaccaaccctgcacctgagctccaaccagatgttaggaactcaccaaccctgcacctgagctccaaccagatgttaggaactcaccaaccctgctcctgagctccaaccaaatgttaggaactcaccaaccctctacctgagctccaaccaaatgttaggaactcaccaaccctctacctgagctccaaccaaatgttaggaactcaccaaccctctacctgagctccaaccaaatgttaggaactcaccacccctgtacctgagctccaaccaaatgttaggaactcaccacccctgtacctgagctccaaccaaatgttaggaactcaccacccctgtacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaaccagatgttaggaactcaccaaccctgcacctgagctccaactaaacgttaggccagttcacaagccgtaaaatcattgctgtggcccagaccagttattccaatggttatagcagttttaacaattgaaaatacttttttttgtgggcctggcctacccaaccgtgacaggaaatccctctgaataatctgatatgtctcatttttactgtcttcttagtaatca

SEQ ID NO: 464764 - DNA, 535 bp, Homo sapiens
tctgttaggctttatgagttaattatgaaaacatacacgtgtttttcaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagctcaaggaaacaaggataaatggctcagaccccgaaggcagtcccaagttcgggatcctctagaatcagc

SEQ ID NO: 464765 - DNA, 1710 bp, Homo sapiens
cgccgtggccgaagcgcggtggccgaagcgggggacgggggtgggacttacggggacagaaggcggagcttccagcagctgctggcccccctgggtccagaggagccttgccgccctcacctgcgcagagcctggagccgacgcgtcacccccagcggaagcgcctcgctgcccgggcgtctggcgaggtgtgcgctccgggtcccagctccagcgcttcgcggcagtcgcccgcctctttccgcaagcagggcggggactgggcggcatctaccgagatctgcgattcgaggcgccgaggagccgaagaccacagctcagctcagacggcgccctagggccgcacagagggtcgggcagtgccggagagaggtttgaaagcgccgccgccaactcgacagcgcgtcccagcgccttgagctcgcttcctcctgctctcaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcagatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagcagtccatcagagccggcttcgcctcacaagacttttgctagaaggcggtgcctacattaatgagagcaacgaccgtggggaaacccctttaatgatcgcttgtaagaccaaacatgtcgatcaccagagtgtcagtaaagccaaaatggtgaaatacctgttagagaacaatgccgatcccaacatacaggacaaatctgggaaaacggctctgatgcatgcttgcttagaaaaagctggccctgaagttgtttccttgctcctcaagagtggggctgacctcagcttgcaagaccattctagttactcagctcttgtttatgctataaattcagaagatacagagaccctgaaagttcttcttagtgcttgcaaggcaaaagggaaagaggtcatcatcatcacaacagcaaagtcgccctgtgggaagcatactactaaacaatacttaaatatgcctcctgtggatatagatgggtgtcattccccagctacctgcaccactccttcagaaatagacatcaaaactgcctcatcgccactttcacattcttctgaaacggaactgacgctttttggctttaaagatcttgagcttgctggaagcaatgatgatacctgggacccaggttcccctgtgaggaaacctgcattggcccctaaggggcccaagctcccccacgctccaccctgggtcaagaatgtttgcaacagcagttaggcgtgtatatatgcacatatttttaaatacatttttgttatattttaacttcatttaagagtagatttaacttacaggtataatgacattttatttattcgtttcacagaagcaagattcagtcacccttgacacactactagttctacaccgccccccagttcctcagcctggtcgatccaggtatcta

SEQ ID NO: 464766 - DNA, 3392 bp, Homo sapiens
aaatgaagagggcagaggggtcatggaccttgcctgtcacacatcttttacgagcaaacaaaatgtgatgagatgactgaagacttgagatctggttagtgataccaccaatgagatgagcaccacagttattcaagccagcccagccctgtccaaggaataggctgtggaaaaattgagagaatttccatttcagaatataggaaaaggaacataaaggaacattaccatctatgatcccaaacgactgatatgaaaaaatgactgcaactacttctctgagtagcaagcctaaagatgtaaaacctaaccttagatcaagtgaagatccttcctccaaaagtggagatctgttggaacccagtgaggtggattggacgtcagacctcaagaaagtggaccggatcgggctggctctcctgagcaagtcaggtctgagtcgtcagacggggtcagctgctcacacctccctgtgtcctgccaggagactgtagatgatgatcaaagaatcatcactaaagctacgtcaactgcaagttgtgagctcagaggccgggacctgttcccagcggaaccattcatggctctgcagctgagacgcagaacatggggctgcggtgcctgcactcttgatgtcacccctcccagcacagcttccttcagccagaggtattgaagaacactcccttcagctggaagtgtcgccctgcctcagtgccaggctggcagggccatagcctgtggcttctcaggaggccatccctatccagctgtcacgggagagcatgtgcagaactctgtggctgtggaatttgggaccaaataccggctctggatggatgggcacctcttccatctgcgacccatattctgatgcctcacatcggaacctgctaagcacagcgaagccttttcctgtgcattctattggtacaaactggaaagaaaccacgagattcaggaatgacatcagtactggtttagagttgaatcctggagtgagcgagtgcttccagcttgtgagtttctgggtgtctgtggtggagaggcagcactcagcaaagacttggaaccaacctaaatgtccaacaacaatagactggattgagaaaatgtggcacatacacaccatggaatactatgcagccataaaaaatgatgagttcatgtcctttgtagggacatggatgaaactggaaaccatcattctcagcaaactatcgcaaggacaaaaaaccaaacaccgcatgttctcactcataggtgggaattgaaacaatgagaacacatggacacaggaaggggaacatcacacaccggggactgttgtggggtggggggaggggggagggatagcattaggagatatacctaatgctaaatgacgagttaacgggtgcagcacaccaacatggcacatgtatacatatgtaacaaacctgcatgttgtgcacatgtaccctaaaacttaaagtataataataataaaataaaaaaataaaaaagtctattaaaacaattttacagattgatggagctatttgaacttgttcatgctcagcatcgcttcatgaatcttctactttttcctctgttgtagactttatgatctgtatttgaaacgaaccgttgtgtagttgatttcagatttctgtttcttgaggcactaatgtttccaccagttacttttgttgaatcttcctgactttctttgagtggattccatttttttggtatttaaaaatgtttcatgcaagttcacattgattgaggctgcttttctgctttaggaatcccatgtgtcctgctttttggaaatgtccctagaggatactttgcagaaatgctggaggcactgaaagccttcgtgatttttagcctggggctcccatgcctggtggggccttggcccaggccttcatgttcctgttaacaaccttcgatgccacccacctctggacaggttccttgttatccccacagacatgcgatcagactttttttcagttttctttttatttctagaaagaatgcttctttgactttctgggctttatgtatagaattcaaatttcattttagcctctccctgtccacaacaagaagtcacaccacaacaagcttgaagtcacatcgattgttctctggaaggtattaaagctttacctccttgagggtcaatctggaccccagacttttctgagccactgtggaagtcagctccctcttgccaggcggcctttgatttccctttattttatggttgtataaggcaaagcaaaatgtgtgtgtgttaaatatattcagccctgtgtatctgtgggtcctgcatcctcacattctaccaagcttgaatcaaaaatatccacatcccctcataaaaaagctggttgcatttgtactgaacatgtacaagcatttcttccttgttactgttctctacacggtaatgtataacaactatttacgtagcatttacactctattaagcattgtgaataatctaggaatgatttgaagtatgaaggagaatgtgcctaggctgcaggcaggtactgtgccatttcatgtcagggacttgcccagattgtggtgtccagtggcgttcccacgtcttcaaatatttccatatgtgggggtctcagggtctcagttatgttggtcacccctgattaaggaagtcagttcttcatgatcataggcactttttggaagctttaaatacgtctattttgatatattttaaacatttttaaataaaatcggaaaatgcgaagatactagtggtatttttgaaaagaatggagaagtcattattctaagagtaggactcattgttaaaactttctaataatagaggggaggtctatgtaatttatacaattgtcacttcatctcaagattaaatagccttttccaggaggcagcagcttaattctctggtccatttgggtatatagatgacctcaaaaaaagaatttaatatttatctttgtagaaaataagcaattggaaagttctccttaatcctgactcttaatttatggctagaaatggcattgatatgaacataaggagtgctatttattaatatattgcttttcataaatcagttccttttttgtaattaggtagaaacagaacagaaagccattcttgattttggtgactggagttgtggaggctggaagtctctgccaataaaagcactgaactggacacacaccacttaccaatcaagttgattctcaatgttgtgagtatgaatgtacaggaaaaaatgctgttcacagaatacattctatgaactgaactatttttgttaaagattttgttaacacagttcatgttcttattgctattggctttactgacactgagtcttctctttc

SEQ ID NO: 464767 - DNA, 918 bp, Homo sapiens
tccaggtctgcccagcaccagacttgcccctcccaatggcctttcagttccctgagctcctgcagcccaaccaccagattcagagtattaaaattcaccttgcttttatttactcattgatacacccctcttcccccacctatgctccctccccactacatgtcacccactctgcaccagttaggcttctagaacctggaaacattttccagggaccctaccttctcccccaggaagctttccaggaattagctttcattgccctccctacttctgaccagatagtttggctccagggaccctaccttctcccccaggaagctttccaggagttagctttcattgccctccctacttctgaccagatagatgtggctgtggacttcaaacaggaggagtggcagcaactggaccttgctcagagagtcctatatatgatgtgatgttagagaattatagtcattaccctaattttagtgcatgaggatagagtccctgaattagaatgtttccaatactgagcactttcactttggttttgtggcctcagaaatatttattgcttttgcccttgaaggattgtgcatctctcttgcctaaataatagcataattgactcatttacctataaatgatattgactttgtcaagtactgatacccaagttttgtgttattttgtacaaacagtatctaccaaagcaaacacgactgtcatactgaagcatggagaagaaccatggacactggggggagaacctcaaggtttggactattaatgaattgaaataatatgccagaagaaccagaagctatcatagctgaagatgtttcattgtctaatgagataatgaaaaaattgagataatgaaaatagtgagataataaaataattaaaataatgagataatgaaaataa

SEQ ID NO: 464768 - DNA, 419 bp, Homo sapiens
cctccctcccatacctgcaaaggcccaattaaagaaacctccctatcctgtcttactgggcaaaggcccaaggaacaccatgatgacatcccaccagaaaaagggtcaaaccccccctatcatgggtacatcttattgatatcctgccgggcagcaagccacactatccagacttctcccagccataccttatctaccaaagcaaacacgactgtcatactgaagcatggagaagaaccatggacactggggggagaacctcaaggtttggactattaatgaattgaaataatatgccagaagaaccagaagctatcatagctgaagatgtttcattgtctaatgagataatgaaaaaattgagataatgaaaatagtgagataataaaataattaaaataatgagataatgaaaataa

SEQ ID NO: 464769 - DNA, 725 bp, Homo sapiens
ggaaatcttcgcgttggaaaagggaatttttatgagactgcaaagaagcataaaatgaatagacaatccaaccaaccaaagaccgggggcagcagcaggccagcaagacggcatcttctccttcccagcctagaagccctgtgaaatcgaggatcttccccctaaaacacatacacacaagatatgtgcaatcaagctgccaccgcttggtaaaaagctcatggtgcctaaccaaaaaggatcaggaacagatccttgaatcagctgtcacttctatagaatgggatttttttttccttcctccttaacctgcgctggaaattgccgttggctttatacatctctatagagagaggctaaagagtcttgcgtgagaaagaagcaatttacaatgcaaatagaggcctgtgaagggacggatgctgctgctcactcgtaacagcttgctgcaccttaatagctggttttattttctgatattaatagatgaattgttggctaacgctgccggagattacttgctgaaaggaaaaagaaaagttcggaataaactctgaaggcaacagatctcgtttggatgttttagccgcgcacacacacaaacagaaaccaggtcatatttacataaaaggaggaatcttaagcgcggcaagtatcctggacgaccactcttcggtactgccagaaaggatcaggacctggagtctggcaagaggaagacagag

SEQ ID NO: 464770 - DNA, 616 bp, Homo sapiens
atccttaattaaattaatctccctcccccggacagaaagagagagagagagagagagagagagagagagagagagagagagaaacgagctggcggagaggagcagaaggcaggaggggaaatctggcacaacggctgggagaggaaacttgatgcttctgggccaccatttgccagggcctcgctcgagccggcgcctcggttcctgcccagctggatttggggggcagcattgcctggcgcagggagatcaaatgagactgcaaagaagcataaaatgaatagacaatccaaccaaccaaaggaaattgctttggagatgaggaaacaaactcttatggagacctaagagactgaagacatctggcgtggactactctgatgactcattgcttccagctgttcgtggaccaatactagatgccagcaatagagaaatcactgcagttccccaaaggaaaaaagtcacgtgttcatgatgatcaaacacagctgtttgattggtgttaaaatggatctgcctgataagacctggaactgagaacccaaacagagccttaaggatgacacatgcttcatacagtaagtgcttcagatgctacccatggaggataggt

SEQ ID NO: 464771 - DNA, 825 bp, Homo sapiens
gctagctggaacgactctcttaatcttccaccgctacacagatagaagataaggctctgcccacagtctccaggctgcagcatctggtgaggaagggaaggtgtatggctgcattgtttttctcttggtgttcaactggaatagagcaggaaattgctttggagatgaggaaacaaactcttatggagacctaagagactgaagacatctggcgtggactactctgatggtaaaattgaaagtacaccctaaatttgctttgttacaggattctcttcagaggacaagagaagatgttacattctctgcatgaggacaattctgcagcatcaaaatcgaataatatttgttttctggcagcagaattttgtatcatatttctaaagacagtaagcacttgggtggacgtcaatgaatactaaacactaattgatctgatacagccgtatgcacatacacagatatacatggtggcttgtaatggttgaaaaattacggtttggttttattaaaagatctgtcacttttaggtcagagtgggattttggagggatagtctcccacaatagaaaactaccctgacaacagtggtgttttgaggttgtttgttgtttggcttcttgatgatgcttagctaaggagacacttcctttcagattctgtcttccaaaccccagggctctgttctgggcagttcagcctaatggaattaagcctgacatgtttcaactctatttcttgataaaataaacataaaacaatggtttagatttcgaaataaaccagagcggccttcctttagggaagggtaatctgaacctcccg

SEQ ID NO: 464772 - DNA, 911 bp, Homo sapiens
caaaccttttgctatgttgtttctggggctacatgcatggacttctaagaagttttctcaagatttcaacagctcctttctttcattggaaggaggagtaacaccatttctttattgtatggcagagatagaagataaggctctgcccacagtctccaggctgcagcatctggtgaggaagggaaggtgtatggctgcattgtttttctcttggtgttcaactggaatagagcaggaaattgctttggagatgaggaaacaaactcttatggagacctaagagactgaagacatctggcgtggactactctgatggtaaaattgaaagtacaccctaaatttgctttgttacaggattctcttcagaggacaagagaagatgttacattctctgcatgaggacaattctgcagcatcaaaatcgaataatatttgttttctggcagcagaattttgtatcatatttctaaagacagtaagcacttgggtggacgtcaatgaatactaaacactaattgatctgatacagccgtatgcacatacacagatatacatggtggcttgtaatggttgaaaaattacggtttggttttattaaaagatctgtcacttttaggtcagagtgggattttggagggatagtctcccacaatagaaaactaccctgacaacagtggtgttttgaggttgtttgttgtttggcttcttgatgatgcttagctaaggagacacttcctttcagattctgtcttccaaaccccagggctctgttctgggcagttcagcctaatggaattaagcctgacatgtttcaactctatttcttgataaaataaacataaaacaatggtttagatttcgaaataaaccagagcggccttcctttagggaagggtaatctgaacctcccg

SEQ ID NO: 464773 - DNA, 883 bp, Homo sapiens
atccttaattaaattaatctccctcccccggacagaaagagagagagagagagagagagagagagagagagagagagagagaaacgagctggcggagaggagcagaaggcaggaggggaaatctggcacaacggctgggagaggaaacttgatgcttctgggccaccatttgccagggcctcgctcgagatgagactgcaaagaagcataaaatgaatagacaatccaaccaaccaaagaccgggggcagcagcaggccagcaagacggcatcttctccttcccagcctagaagccctgtgaaatcgaggatcttccccctaaaacacatacacacaagatatgtgcaatcaagctgccaccgcttggtaaaaagctcatggtgcctaaccaaaaaggatcaggaacagatccttgaatcagctgtcacttctatagaatgggatttttttttccttcctccttaacctgcgctggaaattgccgttggctttatacatctctatagagagaggctaaagagtcttgcgtgagaaagaagcaatttacaatgcaaatagaggcctgtgaagggacggatgctgctgctcactcgtaacagcttgctgcaccttaatagctggttttattttctgatattaatagatgaattgttggctaacgctgccggagattacttgctgaaaggaaaaagaaaagttcggaataaactctgaaggcaacagatctcgtttggatgttttagccgcgcacacacacaaacagaaaccaggtcatatttacataaaaggaggaatcttaagcgcggcaagtatcctggacgaccactcttcggtactgccagaaaggatcaggacctggagtctggcaagaggaagacagag

SEQ ID NO: 464774 - DNA, 1133 bp, Homo sapiens
aagcaaaagaagtttccaaagaaatgtgtgctttgcatcctacaataggaaaatgtagccattgccttccttcagacgagacatttctaatttgttccgtctgtcaggaggggactatgagaggtttgggtgcaaattcattatctctggcaacgcagaacgtagtgtggggactgaaaaagaccagcacgtcctcctcggcagagggggctggactagaccttggacagcccccccaaaaacttgccaagcctcgcacacaccacttcactctccactccgaggctcagggagcaagtgcctggcatgggggacgccgaaagaagcctgtttgtgtgctgcggccgtgctgtgactttggatcttgtctttcagccggcgcctcggttcctgcccagctggatttggggggcagcattgcctggcgcagggagatcaaatgagactgcaaagaagcataaaatgaatagacaatccaaccaaccaaagaccgggggcagcagcaggccagcaagacggcatcttctccttcccagcctagaagccctgtgaaatcgaggatcttccccctaaaacacatacacacaagatatgtgcaatcaagctgccaccgcttggtaaaaagctcatggtgcctaaccaaaaaggatcaggaacagatccttgaatcagctgtcacttctatagaatgggatttttttttccttcctccttaacctgcgctggaaattgccgttggctttatacatctctatagagagaggctaaagagtcttgcgtgagaaagaagcaatttacaatgcaaatagaggcctgtgaagggacggatgctgctgctcactcgtaacagcttgctgcaccttaatagctggttttattttctgatattaatagatgaattgttggctaacgctgccggagattacttgctgaaaggaaaaagaaaagttcggaataaactctgaaggcaacagatctcgtttggatgttttagccgcgcacacacacaaacagaaaccaggtcatatttacataaaaggaggaatcttaagcgcggcaagtatcctggacgaccactcttcggtactgccagaaaggatcaggacctggagtctggcaagaggaagacagag

SEQ ID NO: 464775 - DNA, 927 bp, Homo sapiens
ccagaaagcttgctcttccctgtcaggagccgcctgccgcaggcgggatgaacgagagctgtaaaatgggactgtcccattcccacgctccacggctgcgacccctgtacggggcagtgggcggcggcgcgggaaattccctggatggatttcagacagaaggagacattcctgcttttatcctggagcacacattggggactgagacagctggacagtttggggcaagaaaccaagtgatcaagaagaaggcttatgagccgggccgcagacgaagaggtggcaagtgcaggcagtttactgcagcgtcggagagtgacgagttgcccctcaggggctccgtcatcatggggaaagatgagcaagccttgctaagttgcatgttcttctcaagtgctggctttctgcatgccatccctgtgaaacaggaactttctagaatgtgtctcactatcactaatggtcataatggcaagaccttcgtaaatgggattagtgcccttataaaagaggcctgagagacactcctcgtcccttccaccatgtgagcacatggcaagaaagtgccatgtatgaaccataaaataggccttctccagatattgaatctgccagtaccttaatcttggacttctcagcctccagaacgatgaagacccctagacttcagagaagatgatatctaagtgtcagagctgggattccaaaccagatctgtccagctccgaagactgagctcataacccttaacactaatcccctctctgacccagcgctgtgattctaggctagtctgattaaagccccagaatttcacaaccttttaagaatacagtcaagaaagaagagatcattgtttcaacctgcctctgaatcgtagtaaataacgggccctgatattaacaaggcagcttccctcctaagtgc

SEQ ID NO: 464776 - DNA, 1299 bp, Homo sapiens
cagaattcctctgcttatatagaaacagaaagagctcgaacgccatgctgggagaaccactgctgtcttcagagctgtctgacagggacgtttaaatctgcagaagctgtctgctgccttttgttctgctctggtctgccctcagaggtggaatctagagaaacagtagtccttgctgagctgcggtgggctccgccaagttcgagcttcctggccactttgtttaccctgtgagctactcaagcctctgcaatggcagacgcccctcccgctgtcaagctgcagcataacaggttgatctcagactgctgtgctagcagtgagcaagactctatgggcatgggatgtgccaagccaggcatgggagggtatctcctggtctaccggttgctgagaccatgggaaaagagcagtatttggtcaggagtgtaccgtttctccagtcaaataagaaatcctcctggaaaaggagaagaaagtcctcccttgagggcttcagcaatgttcctttcttcaggagcagctccctccagcaagagtcctgcttatgattctcccttgggtcagtgcagtcttgttaaccacctgctgggcctgctaactgcctctctgctgatttccatcctaaacaatggctctcaaactttggctggcatcagtcacttggggggttggtttgtaaaagcacagattgctgaccccactctcagagtttctgattcagcaggtctggggtggggcctactaatgtgcatttctaactagttccctggagatgctattgctacatcttgaagaaatgctgctttaatatatacagtagaagtatttttaaatagttgtttattaacaaatatagatcattttctgtaatccaggggtacacttacaaaccactttttactgctagatgctgagcgtttaaaatgtttccaaagatctctgaatcacaaaatcacagaagctcaagtgttgggcattaccttacggagccagattttctaatttcgtcttcttcctttctctctctctctctgtttttctttttttcttctgagacagagtctcactctgttgcccaggctggagtgcaacggcatgatctcagctcactgcaacctccacctccgaggatcacttgagtcttggaggcagagtttgcagtaagctgagatggtactactgtactccagcctaggtgacagagccagagcgagaccctgtctcaaaacaaaacaaaaaaacaagaaagagagagagagcgagagaaagaaagaaagaaagaaagaaagaaagaaa

SEQ ID NO: 464777 - DNA, 1726 bp, Homo sapiens
ttttcagatggatgttcatgtttctgactttgcattaccccagtgtaggctccggacaggcatgcgaggtgcctttggaaagccccagggcactgtggccagggttcacattggccaagttatcatgtccatctgtaccaagctgcagaacaaggagcatgtgatagaagccctgcacagggccaagttcaagtttcctggccgccagaagatccacatctcaaagaagtggggcttcatcaagttcaatgccaatgaatttgaggacatggtggctgagaagcggctcatcctagatggctgtggggtaaagtacatccccagtcgtggccttctggacaagtggcgggccctgcactcacgagggcttccacttctcatgtcctcccggaatcctggccagcgggctgagctgagctttgctgctgccacaggagccactcctattgctggccacttcacccctggaaccttcattaaccaggtccaggcagccttctgggagctgcgtctgttggtagatactgatcccagggtggccactggcctctcacagcagcatctcatgataacctacctaccatacctctgtggaacacaggttctcctctgcgctgtgtggatatttccatcccatgcaacaagggagctcactcgggggtctgatgtggggaatgctggctcaggaagttctgcacatgcctggcactgtctcctgtgaacacccattagagatcatgcctgatctctgcttctacagagatcccgaagagatggaaaagctcatgcctgtaatcccagcacttgaggaggccaaggcaagcagatcacgaggtatacatctagatggcccgaagcaactgaagatccacaaaagaagtgaaaacagccaggtcttgcctttccaccattgtgctttgttcctgccccaccctcactgatcagttgaccttatgacaatacacgctccccgcccctgcgatcatgtactttgtgatattccccgcccttaagaaggtactttgtaatattcttcccacccttgagaatggactttgtaagatccgccccctgcccacaaaaaaatttctcctaactccactgcctatcccaaacctataagaactaatgataatcccaccaccctttgctgactctcttttcaaactcagcctgcctgcgcccaggtgattaaaaagctttattgctcacccaaagcctgtttggtggtctcttcacacagacgcgcgtgacagaaaccacttgaagccgggcgcggtggctcaggcctgtaatcccagcactttgggaggctgaggtgggtggattacctgaggtcaggagttcgagaccagcctgaccaacatggtaaaaccctgtctctactaaaaatacaaaaaaattagccaggggtggtggcgggcacctgtaatctcagttacttgggacgctgaggcaggagaatcgcttgaacctgggaggcggaggttgcgatgagttgagatcaagccattgcactccagcctgggcaacaagagtaaaaattccgtctcaaaaaaagaaaagaaaagaaaagaaaagaaaccacctgaagctggagaaagaaccccctcaaaagaaccatccctagacctcacacagacagggctgtggatcattggtattcaggcagagtgggaaaacctcatcctgcccagggcatccagtagagtagtcaagagttttt

SEQ ID NO: 464778 - DNA, 2068 bp, Homo sapiens
agcagcagcaggtaaagacctctggatgcggtacctgtggcctgagctactgccagcaaggcggcagagctgaagatatggcttttgttcgactgattctggaactgtgtaaggagctgctggattctacggtgcccaataggcagctctcacctgacggacaaagagctgcagggcttgtggatggcagttccaaggtggatcacagcacaattgacctggtgaagttgtacccccaacactggcaggtcaccctaattccctccctccaatccctggcctggcctgacctcgctggttctgagacagccaggggggaggcggtccttggagaaggtccaccctctccatctttcctgcccactgggaggagccacacaggttcacaccatttgccgcagggagtagcctggcccctcctcttcctgtgtggaaactgggatgcgaatggctggtgggaagccccaaaatgggatgaggatggctggtgggaagcaccctagcagggactctggcttagcgagagtccctgtttcccctttttcttcctttttcacccaacaaaaccctgtcttactcattcaaattcaaattgtctgtgagcatgaattttctccactgcacaccgttctcctctccagacctctcactggcaagtcctttcatctcaatttcagttctgtgaggccgtcctactattgtctatcaccctgtttgatttttttgtagcctcatcatttattcattacagtttcttaagttcttttttttagggagcttgtcattgcctagaagagtgctgggcacacaatagtgatactgaatatacaactaaaatcatgtaatatagcacatgagattcttaatgctaaaattaagactttttaacatgaaaaatgctcttaagggcagaaatgaagcaaatttcaggcaagatggcagacaagactgaaacggattcatccatcaactgctacagacttaaaaaacaaaatatgcccaatgcaaagctgagctcaggaaatcctcagatgctagagataaagacaaaatccagttgcagaagtgagttccaggtgatgccaggagaccccaggaagtatcagattaggtcacaaaactaggaataaggttttaatgtcttcagaaaaacagagcatttggtgagagaagggaactaatccgagactcccgcatacaaccaggacacttgaagggctgcctcacctgtgaaaaagaaactggaaaaatctcttcaaatctgtctgtggaaacagaaagacagcctggtgtttgacaaagctctcggtgggacaaacctcctctgagaaatggaaacctaggaaatcaaaagcccagaaattaagggaaagcattagtctcagataatgaaaaggaaacccttggggcccgggccaaagcaaatgtaaaaacatgaacacttgcataatctcgtacatgggactcacagaaaatgcaacccctaatatagatgagctcgcaatgaaaaattatccaccactgtggcaatgcagtcaccaaaaggaagactcaacagaccaatgagcatagacacgagctgtggagtatgatcagcttgtcgaaagaatgaatcaatgacactctgtcttcgtggagagcagcctgggtgtggaatcaggcacccccgggttcaaagccatcactggcgaactcacaaagagtgggactcaccgacctgagggtttgccagcacactcgtagcccgcgggactagagtatttgtgagagaggagtgtggtcttttgattgaagaacagaagtcattcgtgaaggacacagcacacacagcccagagagctcgcaggttaaaactgcacatggagcaatgtctgccagccattcagggtacttcaaaatagcaaacacagtattcacaatcaagttatttagaccttttagattgtatacaaatgacatagaaaaatgtacagccagtccactgggttgtaattttagaaacaaacatctcaagtcataataataaagtagagttttaaaaagttactaggttttctttatttgccat

SEQ ID NO: 464779 - DNA, 1979 bp, Homo sapiens
agcagcagcaggtaaagacctctggatgcggtacctgtggcctgagctactgccagcaaggcggcagagctgaagatatggcttttgttcgactgattctggaactgtgtaaggagctgctggattctacggtgcccaataggcagctctcacctgacggacaaagagctgcagggcttgtggatggcagttccaaggtggatcacagcacaattgacctggtgaagttgtacccccaacactggcaggtcaccctaattccctccctccaatccctggcctggcctgacctcgctggttctgagacagccaggggggaggcggtccttggagaaggtccaccctctccatctttcctgcccactgggaggagccacacaggttcacaccatttgccgcagggagtagcctggcccctcctcttcctgtgtggaaactgggatgcgaatggctggtgggaagccccaaaatgggatgaggatggctggtgggaagcaccctagcagggactctggcttagcgagagtccctgtttcccctttttcttcctttttcacccaacaaaaccctgtcttactcattcaaattcaaattgtctgtgagcatgaattttctccactgcacaccgttctcctctccagacctctcactggcaagtcctttcatctcaatttcagttctgtgaggccgtcctactattgtctatcaccctgtttgatttttttgtagcctcatcatttattcattacagtttcttaagttcttttttttagggagcttgtcattgcctagaagagtgctgggcacacaatagtgatactgaatatacaactaaaatcatgtaatatagcacatgagattcttaatgctaaaattaagactttttaacatgaaaaatgctcttaagggcagaaatgaagcaaatttcaggcaagatggcagacaagactgaaacggattcatccatcaactgctacagacttaaaaaacaaaatatgcccaatgcaaagctgagctcaggaaatcctcagatgctagagataaagacaaaatccagttgcagaagtgagttccaggtgatgccaggagaccccaggaagtatcagattaggtcacaaaactaggaataaggttttaatgtcttcagaaaaacagagcatttggtgagagaagggaactaatccgagactcccgcatacaaccaggacacttgaagggctgcctcacctgtgaaaaagaaactggaaaaatctcttcaaatctgtctgtggaaacagaaagacagcctggtgtttgacaaagctctcggtgggacaaacctcctctgagaaatggaaacctaggaaatcaaaagcccagaaattaagggaaagcattagtctcagataatgaaaaggaaacccttggggcccgggccaaagcaaatgtaaaaacatgaacacttgcataatctcgtacatgggactcacagaaaatgcaacccctaatatagatgagctcgcaatgaaaaattatccaccactgtggcaatgcagtcaccaaaaggaagactcaacagaccaatgagcatagacacgagctgtggagtatgatcagcttgtcgaaagaatgaatcaatgacactctgtcttcgtggagagcagcctgggtgtggaatcaggcacccccgggttcaaagccatcactggcgaactcacaaagagtgggactcaccgacctgagggtttgccagcacactcgtagcccgcgggactagagtatttgtgagagaggagtgtggtcttttgattgaagaacagaagtcattcgtgaaggacacagcacacacagcccagagagctcgcaggttaaaactgcacatggagcaatgtctgccagccattcagggtacttcaaaataggtcagaatacgtttccagaaagtgacaccttctttttgggtttgcgtataataataaatctaggggataagaacataa

SEQ ID NO: 464780 - DNA, 2381 bp, Homo sapiens
ctgtcctcgtgcccatgtgcacttgagttgacggtgacctcattaccgcctccgcaaaggccccttgaaatccctgcgccgtcgcatttggctgctcaaagtgatgggaacggcctgagcttcctgatcaatcgcttaaaattcagggtcggctcgctcgcgggagagggctgcctgccagcccgcgcaccgcgctctgccgcctccccctacaccccctccttgctttggcggggcgatgctgtcgtattggaaaacatccccgcgctggctggggggcccggtggggccagcgctggaagccgttccactcgagcagatggctgtgaaactttggcggcgagataaattgggtctgacggcagccccctttggcacccgcctcgccagcacaagccttcaggaggccacccatccggcaacagccttcctcagccgaaggcgccctccaccacattccttccggccccagatctccccagagacgagcccagagggagggacagcccccagcccccgcccggtcacctccgccaagctggcagctgggctttccccctcctctgccatccgcagaggcctgaagcgtgaagcccgttctgtggcggtcctacaaagaagcgggggtgcctcacttctcgggcctcccccgcgggggattctgtaccagaataacacccccggggccagggtcagggcggcacactcgcccccgcctgtcccagcgcgatcccattcggcgggcccagtgacacagcctggagacccagctctgtcactcaactctacatagccttcacccagagcctgacagtgtatatgaacaagaggctgtgcctggtgagtgcttctgccactttctccaggatgacagctgtggactcctgccacatccaacacccccttgctgctccccaccgccctccttggcacccaggtggctgatctcctatggtcttgctggcttctctaccttgtatgctgagggcgggcccagcctgccccagctcagggtctgcacatagtaggtgcttgcatgttgcctgctaaactgacagccctgtaaccatgtcagcacaaagcaaccagcattttgggtgcatctgcagttaaaataaaccactgaggtcatgggtctgttctctctgcaaaaacaaaaataccccactagccatatctgatgagaaccatagcaaaagatcagaatgtaatggcttcatccagaagcaaagcatgagattccaaaccatgtccctgacctgaaggggcacctgcccaggcccaggggtgccaactcctagaggcagctggcatgtgactactgtgcccagtagagaaaggcagacactcagtccccagagcccagagccccgagggaattatggaacatcctccatatttgattcaaaataaaaaccacagtaaaccatagacccaaaacttatacgtcggctgaaattaaaatagcttcttgctacgttttctggtttcaatattctggataaactcatggaagctgaatcaggcaatttgtctgtctcttgctttgtttctgctgttgcccctgctttgcagggatctcagcacacgcttggtctcccctctgaagcagaccccagccgggtctggggggtgtccagtcctgcactcccagggctgatccccccaggaaggtatccatgcctatgcacacaccacccccatgggttcttgtggcccctcaggaagggggcaggaccagggcccagccttggccaagagctgcccccagcagacctctctctgccactgctccccacaaggtttccagcacccccagcccctccctcttctggggaaccttgcggctgggcccgtgcctgcggcgagtctcaccccagtattattttagtcgcagacagacacgaggcagatggtgacaacatcccttccccgctccccactgacgagccgttgccgccctgaagcctcagggttcttctccctcaggaatatttcagtcccgactcggtggctaaatgcggctgctcgtgtgagacaagcgcacatctgcgcctcctcctccctaccccctacccatttcctgaggctgagcagagccctggggaggccctgcccacttgcagctctgccccatcctcccagctgccctactgtgtgccaggcatcatgccatgagcatggtaccactgggagagggcagttactgtgcccactttacagatgaggaagctaaggctcagagtgaagcaggggccatcccagatcacacagcaggagagaaggcgttcccttgggtcccagtgcaccctggagacagacacagcctccctctgctccttccccacccctcaatcctccaccttaccacccctgtgcct

SEQ ID NO: 464781 - DNA, 659 bp, Homo sapiens
cactcacatgctcactcatacactcgcacaccctcacacacactcattacacactcacaaggtcacttacacacacattcctacacacacatattcactcacacactcatacactcacatacacatgtatctcacacaacccacactctcacacacattcacacactcaataactcacacactgacaggaatattttctcatttcacccacacaaaaaaaccactagttttgaaacaattagattccctgagaattgatgtctccctgacacaatcatactttaaaaggcaggtcttaagtgaagggatgactttatcgtttaattttatcaatagttgggctcagttggccatcaagctgtctgcaagggttttcctttctagcaatgactttgctgctgagaccctcatccaccgtcgtggtgcccagcgtgagtgacgggagctacacgcaggtctttatagcacatcacctgtgactggcataaaaatgggtcaagggctgggcgcggtggctcatacctgtagtcccagcaatttgggaggctgaggcagaagaatcgcttgaactcgggaggtggaggctgcagtgagccaagatcgcgctactgcaagatccagcctgggcaacaagagaaaaactccatctcaaaaaaaaa

SEQ ID NO: 464782 - DNA, 988 bp, Homo sapiens
taagactaacaaactctcttcaaccaagtaaaggagactccttgtggaggggagcccctgcccgctcacctggatgaccatgcctcacctctgccgatcacatgcaaatatttgtcctgttctgagacatcctcctgggtcccagcttcttctcttgaagatacagatttccagtgcaccatcagaagccgaagtaactgtgagtgggaggcattggagccggctgggaggtaagcattcgggccagcagggaggaggagtcgcccatgtagcagtgctggatgacaacattcccacactgccctcggacacatcacagaccctggtaccacaggatccctctgattcaactgaagagagatgcagagctgcatgccaccaagtaactaattcgttcttctcttcttatatccattgagcagtgtgcagtgttggcacaatgcacagtacttgttaaccactccaggaaaagaaagagccactcattctgattagctgtcagaactaattttaagctatgttattatatggtaaagaggaaaaaggaaatacaaggaaactgtacttaaagccagtgcctaatcaggttttttccccttcgtctgtttcatacaaaagctccctggaatcactgctgaaagggagcaagtctggtcatatcctcaacattatcagatgtcaaaaaacatcacatccgcccccttttgagaacgtgcctcggtgtgatggtgtggagcgattcacagtgcaaacacctgtttcccatgataggcaagtgtatgttttctcttttcacagattagcctacactccagggaaaattagtcagaataacagagccacagtgaatttgggtcaggccgatccaagggccggcatcttggatttaaattcgatctgccaggttcttccttggtcacagccacaccctcccagcttcctgctacctgtggaagaggcttaatgactgaaaaggcatgacctgtgc

SEQ ID NO: 464783 - DNA, 3186 bp, Homo sapiens
cctgggattgaaccacagaggacggattatcctgaagaaatgtcaccccccccttaatgaactcagtgttcccccccacaagcattgttgcaagagaatcaccctttggtcatcttgcagcctgggaagagacctttacctgtggaatccccggatactcgaagtggaggatacacagatgtgattacgatggatgcaacaaagtgtacgctaaaagctcccacttgaaagcacacagaagacgacacacagaaaaaccctacaaatgtacatgggaaggatgcacatggacgtttgctcggtctgatgaactaaaaagacatttaggaaaacatactggaatcaaacctttacagtgtccggactgtaaccgtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaaccttttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaagtcgacgcggccgcgaattta

SEQ ID NO: 464784 - DNA, 2725 bp, Homo sapiens
atcattgatgatcagctgagagtgatgttttttctctacagtgccatgctagcaagagaagcttaagcattttgtgaggcataaacaaaaatgcattcattaaggattaagttcttattcatatcttctctttctgaaggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaaccttttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaagtcgacgcggccgcgaattta

SEQ ID NO: 464785 - DNA, 2952 bp, Homo sapiens
gcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaaccttttttgtttttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaagtcgacgcggccgcgaattta

SEQ ID NO: 464786 - DNA, 2863 bp, Homo sapiens
gcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaaccttttttgttttgttttgttttgttttgttttgttttgttttggttaatggaaactgaaaagagcagtatttgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaagtcgacgcggccgcgaattta

SEQ ID NO: 464787 - DNA, 308 bp, Homo sapiens
gtgttgcgaggaggagagtcagtgaaggccgaaggtggggggtcaaaccggaagacgaagcccttatcaaatgggcacgcgtctctaggttcctaaaaaacggaagaaaataaaaataaccggccgggtgcggtggctcacgcctgtaatcccagcacttggggaggccgaggcgggcggatcacgaggtcaggagatcaagaccatcctggctaacacggtgaaatcccatctctactaaaaatacaaaaaaattagccaggcatggtggcgggcgcctgtagtcccagctactcgggaggctgagg

SEQ ID NO: 464788 - DNA, 1018 bp, Homo sapiens
gcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaactgtatccgacaactcttccctctcgttctgctagagaaaaatcaacaact

SEQ ID NO: 464789 - DNA, 1001 bp, Homo sapiens
atcattgatgatcagctgagagtgatgttttttctctacagtgccatgctagcaagagaagcttaagcattttgtgaggcataaacaaaaatgcattcattaaggattaagttcttattcatatcttctctttctgaaggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctaaaataaaaataaccggccgggtgcggtggctcacgcctgtaatcccagcacttggggaggccgaggcgggcggatcacgaggtcaggagatcaagaccatcctggctaacacggtgaaatcccatctctactattttttccatgttagaaggatcctaatgaacagcaccctgtcatttttaaagttctaagggtctagtcgttccagacatccccaaggaatatttccctaagctcactcagtcaccatgtaggagccagggtaggctatggaattatcttaggaactcaagcttctaaaactatccatgtcgtcaactctaggggacacaccccgcacaacacaaacacagacaaaaaaacatttgggggcacgcggccgcagaaggtttacacaacttgtgggggcgggacacaagagacatgaacagtgcaaccggccaagaaccgggccgcgggctggttcccaaaaaaccggggcccggggtctcga

SEQ ID NO: 464790 - DNA, 2974 bp, Homo sapiens
gcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaaccttttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaagtcgacgcggccgcgaattta

SEQ ID NO: 464791 - DNA, 2917 bp, Homo sapiens
gcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaaccttttttgttttgttttgttttgttttgttttgttttgttttggttaatggaaactgaaaagagcagtatttgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaagtcgacgcggccgcgaattta

SEQ ID NO: 464792 - DNA, 2920 bp, Homo sapiens
gcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaaccttttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccatttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaagtcgacgcggccgcgaattta

SEQ ID NO: 464793 - DNA, 1823 bp, Homo sapiens
gactattttcttgataatgtagctgggataaactagaaaacaagtttccccatggtcagctggaaatactcatattgcacttggacggagcagattgtttctgaagagggccagtgatgagcaccagttccctccttgcccaggccaacagcgtttcacaggacccctgggatcgtcctgatggttctcttccaaacaatgatctagaaagatgccccgtgtcaagttgcttgcctttcgaaggtcttcaaatcattgttcctccatatcatattcagagctagtgctttcatgctgatgtggaaacatctaagaggactcataatgtcaacatgcatttccccaataagtaaacaagagaaatgacactgacaagaacaagaaatgattatttcttctgccaaagttggaagcgaccagatacggatacgaagagatagcccaggttgggcaactggccctggaagctgataatgaccccatggcaacgcgggccctggacacaggagaggagagaaggccacagcgcggaggccctaggacgccgcatggagaacattggaggcgatatcttcccaatgagaggtgacagcgggctggcagtcctcagagccctcgctcactctgggtgcctcctctgcctgggctcccactttggcggcacttgaggagcccttcagcccaccgctgcactgtgggagcccctttctgggctggccaaggcgggagcccactccctcagcttgcagggaggtggggagggagaggcgcgagcaggaaccggggctgcatgtggcgcttgcgggccagctggagttccaggtgggcgtgggcttggcgggccccgcactcggagcagccagccggccctgccggccccaggcaatgagggacttagcacccgggccagcggctgcggagggtgtactgggtcccccagcagtgccagcccaccggcgctgcgctcgatttctcgccgggccttagctgccttcccgcggggcaggtctcgggactgcagcccgccatgcctgagccttcccccgcctccgtgggctcctgtgcagcccgagcctccccgaggagcgccgccccctgctctacagcgcccagtcccatcgatcacccaagggctgaggagtgagagcgcatggcgtgggactggcgggcagctccacctgcagcccccgtgcgggatccactgggtgaagccagctgggctcctgagtctggtggggccttggagaacctttatctcagggattataaacgcaccaatcagtgccctgtcaaaacagaccactcggctctaccaatcagcaggacgtgggtggggccagataagagaataaaagcaggctgcccgagccagcagtggcaacccgctcgggtccccttcgacactctgtggaagatggtaaaactgagattcaggatgatgaataacacacccaagagcaatagccaagtgtcagagcgtggactcaggccccaggtctgcccaggcagagccaagagcctcatccgtctactgcattgctgttaccaggagtggagcttgggattctcctagtgctcaccctgccatctctactgaattgaattttgtgatgtaaaggcagtgttttgtgtcaagcctgctactcattccaccacttcccagctcagggatctcaaacccgtttcttcatgtgtaaagtgagaaataacaaaatggggataataataacttatcccttatgattgttgtcaagattaaatgaattactctaagtgcattgctgagaacacacctggaacccagtaagcattcaatacgaggt

SEQ ID NO: 464794 - DNA, 2084 bp, Homo sapiens
tatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaatagcagaaaacgctcttccaaatgtaatggagtcagctttttattttgaacaagctggagttggtttgggcacagatgagacataccgcatatttcttgccctcaagcagcttactgatacccacccaatccaaagatgccgcttctggggaaagatcttgggtctggaaatgaattatattgtagctgaagtggaatttcgtgagggggaagatgaagaggaagtggaagaggaagatgtagctgaagagagggacaatggagaaagtgaagctcatgaagatgaggaagatgaattaccaaagtccttttacaaggccccacaggctataccaaaagaagaaagtagaacaggtgccaacaaatatgtctattttgtttgcaatgaaccaggaagaccatgggtgaagttaccaccagttatacctgcacaaattgttattgcaagaaaaatcaagaaatttttcactgggcgattggatgctcccatcataagctacccacctttcccaggaaatgagagtaattatttacgagcacaaattgcccgaatttcagcaggaacccacgtcagtcctctaggattttatcagtttggtgaagaggaaggagaggaggaggaagaggcagaaggtgggcgaaatagctttgaggaaaaccctgattttgaaggcatccaagtgattgatctagtagaatccctatccaattgggttcatcatgtacagcatattctctctcagggtcgctgtaattggttcaactccatacaaaaaaatgaggaagaagaagaggaagaagatgaagaaaaagacgattctgactacatagaacaggaagtggggcttcctcttttgacaccaatctctgaagatttaggttattttacgaatgcaaacattgaagagcatgacgagccaaaggggccagcgtccttgactgcaacttcccgtaaagacagcagtgcattgtactccaagtctgatgtgccaggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaattaaaataaataaataaatggtctcaggtttaatttgtaatacgacaaacactggaagatataacccacaggaaattcttggaaacatcaatactttttaaagagtgtcaaggggtatgaagacaaaaaatattgatagtcactagagtaatgtattcttaacctttgtaagaactgatctcagcatgtattctt

SEQ ID NO: 464795 - DNA, 2729 bp, Homo sapiens
atttccgtttcaaaccacccacttccggtttttcagccggttccggtcccgcccttcacttccggtcgctttcggtctctcagcggccggtttctgcgtccgctgccgcaggttccaccgcgctccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggcaaacctgcagaaaatgatgttaagcttggagctctcaaactgaaaccaaatactaaaatcatgatgatgggaactcgtgaggagagcttggaagatgtcttaggtccaccccctgacaatgatgatgttgttaatgactttgatattgaagatgaagtagttgaagtagaaaatagggaagaaaacctactgaaaatttctcgcagagtgaaagagtacaaagtggaaattttgaatcctcccagggaagggaaaaagcttttggtgctagatgttgattatacattatttgaccacaggtcttgtgcagagactggggtagaattaatgcggccatatcttcatgaatttctaacatctgcctatgaagattatgacattgttatttggtctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaacattcgttatctgttctatattaccacatatattttacctctttgttgaatgacaaaatgaacattatattcaggcaaggatctcttgcaaaaacttaaatgtgtatggtgatgttaaaggtgtgtatatcactatttatacattcaggagtagttttagcagctaatcagatacataaaattacttaattctaataagtaccttttttcagaaatatatactattttctttgtgacaggttttgaggatatacagtgcagaagagtttgaggactctaaagtgattcaattaaaatatatttcttaattatgaagtaaaatttaaatatttaaggatagaacagaaattttagagtattcatttttcattggtacatttttcccactgtaaaagacaacttattccaaagtacgcacggaaagggcttaatcttctcaagaaaatggaacacttaaactattaacataggtcaagaacgggcagacattttc

SEQ ID NO: 464796 - DNA, 398 bp, Homo sapiens
gtctcttttaggaagattctacttagccaccaaaaagagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaaca

SEQ ID NO: 464797 - DNA, 2268 bp, Homo sapiens
  misc_feature (2258)..(2258): n is a, c, g, or t
atttccgtttcaaaccacccacttccggtttttcagccggttccggtcccgcccttcacttccggtcgctttcggtctctcagcggccggtttctgcgtccgctgccgcaggttccaccgcgctccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggcaaacctgcagaaaatgatgttaagcttggagctctcaaactgaaaccaaatactaaaatcatgatgatgggaactcgtgaggagagcttggaagatgtcttaggtccaccccctgacaatgatgatgttgttaatgactttgatattgaagatgaagtagttgaagtagaaaatagggaagaaaacctactgaaaatttctcgcagagtgaaagagtacaaagtggaaattttgaatcctcccagggaagggaaaaagcttttggtgctagatgttgattatacattatttgaccacaggtcttgtgcagagactggggtagaattaatgcggccatatcttcatgaatttctaacatctgcctatgaagattatgacattgttatttggtctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaacaaaaaaaaaaatttcactgtnccgtcgttta

SEQ ID NO: 464798 - DNA, 1713 bp, Homo sapiens
attctgtcttgaagacacactgcagtaagtttacttttatcaatatttaaaagaaaattaccataagtatgctagggactgttaattctgatgcatttaaacttttagttttgcttagaaaacttacttatacagattttttttaaagaaattcaagcttttcatatgtattgtattatcattcctcgtgttttagctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaaca

SEQ ID NO: 464799 - DNA, 1072 bp, Homo sapiens
taaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttacccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaaca

SEQ ID NO: 464800 - DNA, 671 bp, Homo sapiens
ctggtattggggttaaatttttatgaataaaataatgtgaatgaaattaattagaagcaactagaatgataggaggcgggaaaggctaagtagttttgcaaagtagagtagctgtgtatggattcaagtgcaataagaaagctggtgttgtcaggttcagattgaaaagataatgttaggtaaaataggtagaagagtttgtaatttgtaaacattatacatgactttctatttaggctaatataaaagtaatttttagtatttatgttcttggtgatattttaacctcattaactctaattgaaatgatagtatagatttgttagttttccttatcacattgtgatgtgttgagtaatgtttgtttcctaatagataaggccttttatgaaagcgcacctaaatcgtgataaagacaaagaacttttaaaattaactcagtacctcaaggagatagcaaaattagatgactttttggatctaaatcacaaatattgggaaaggtaagttttaattgcttatttattttctctttacatcaatgaagaaaaaattatcatttttcatcagtgaccccagtatatatatagctgtcttaatttttatttaaaataggtgacttctaaaaacattttctaatccagtgacctacccccaaaagtattttcccc

SEQ ID NO: 464801 - DNA, 304 bp, Homo sapiens
cttaggtccaccccctgacaatgatgatgttgttaatgactttgatattgaagatgaagtagttgaagtagaaaataggtaagtgcttttcgctttagaagtaatcagttgtcatgtgagaacaagtgaatattttatctaattatatgttttccattagggaagaaaacctactgaaaatttctcgcagagtgaaagagtacaaagtggaaattttgaatcctcccagggaagggaaaaagcttttggtgctagatgttgattatacattatttggtaagtcagttaagaatgcttttcattt

SEQ ID NO: 464802 - DNA, 2238 bp, Homo sapiens
atttccgtttcaaaccacccacttccggtttttcagccggttccggtcccgcccttcacttccggtcgctttcggtctctcagcggccggtttctgcgtccgctgccgcaggttccaccgcgctccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggcaaacctgcagaaaatgatgttaagcttggagctctcaaactgaaaccaaatactaaaatcatgatgatgggaactcgtgaggagagcttggaagatgtcttaggtccaccccctgacaatgatgatgttgttaatgactttgatattgaagatgaagtagttgaagtagaaaatagggaagaaaacctactgaaaatttctcgcagagtgaaagagtacaaagtggaaattttgaatcctcccagggaagggaaaaagcttttggtgctagatgttgattatacattatttgaccacaggtcttgtgcagagactggggtagaattaatgcggccatatcttcatgaatttctaacatctgcctatgaagattatgacattgttatttggtctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaaca

SEQ ID NO: 464803 - DNA, 1269 bp, Homo sapiens
ccacctcacctcaagtcgcctatgcacctgaacagcgtgagcatgcatgtgatagtggtgcaggggctgctggtgggagggacatttgtgggcatggacagtggctgtcctgggtttgaagccacagcaccaaccgtcacactggctagggcagcaccaaccgtcacactggctagggcagctccaaccgtcacactggctagggcagcaccaaccgtcacactggctagggcagctccaaccgtcacactggctagggcagctccaaccgtcacactggctagggcagctccaaccgtcacactggctagggcagcaccaaccgtcacactggctagggcagctccagcagtaggggaaggggagtggtggcttaggcatctggggtctgtaaaggcaaaaattgatgttaatgtggcatctgttgccaacaaatattttgcatatgatacaatctatgcaatcacaatgggagggatcaagaggagccaatcacaatgggagggatcaagaggagccaatcacaatgggagggatcaagaggagccaatcacaatgggagggatcaagaggagccaatcacaatgggagggatcaagaggagccaatcacaatgggtgggatcaagaggagccaatcacaatgagagggataaagaggagccaatcacaatgggcgggataaagagaagcagacatggagccctgcaaacttggcctaaacattgctctcggtgttctagcatcataatgtgacttttctttttaaccacagtttgttgttaatttataaagttacactaacttccacctccgatacagagcttctaaaagaatcaaagtataaaatatatgtggttgtaaaaaagtgccttgtaaattctaaagcactagagagtgaatacatctccaggatgaggccacccattttggcttccactaacccggaggaacctggagcaaggaaaccaaaggaagtattcaggaagcttcagatttgactgctggcattataggcaagaattacacacacatgacttactgttcactattggtgagaactcgtgttctcatttcgggcaatgtttagaatgaagctccattaaacatgcttgctccgaggaatatccttagaacggccatgcttcttattgtgattgttatgttattttaagaaggtgacccctaatctgagggccaacgctgcaaagcggctctgtctgtttcaaagctgagcacacgtggtgtcacgtgacacatggtcttttgc

SEQ ID NO: 464804 - DNA, 800 bp, Homo sapiens
ttgagagaaacagggaagttaggatgggaaaccggtttttggaggggaaactgggcttgaaagatgactatttcatttttggacacacgttacgttttctctctggagctgtgtttaataatggaataatgtgtgctcataacagtgtggactgcatcctaagcctagctctcctcatggttgaggagtggctgtcaacagtagtcaaagttctttgctttcttttccatggcctctcctccaacatcgaggattacaatttgacaaaagatttgagtggcgacacagacccaaatcatatcagcaccaacaagacctacgaaaatgaagttaagatagaacttgggcaagttaaccttgttcttaactgctgtacctcattgcctgatgtctgttctctctcaaatattccacgtgtctaatcaattagaaacatttcaaccagtataagagtatatgtaaactagtataagagtataaataaatgctgtcttaatcgctagacacattcagcttctctatatagcctttttcaaaggatattttgtaagtaccaattaatattgaagaagattttggtctaagatatctgattgtcagtttacgagtgaagcgttttagtttcaaagctccagatctctttctgattccctaatatgcaagtatacaagatttcattccataattaaattaaaatagtttatccacaataaaatctgggaaaatcaaacaatgtttatcttctcctgggtttatttattaagacaaactcctctaagggaggtggagcaagatagcca

SEQ ID NO: 464805 - DNA, 739 bp, Homo sapiens
agccgggtcgcggggccaggctggccgcggggctgggggcggccagtggggcaggagctccggccgcgtcaaggtcgggtggaaaaactaactgaaagctgagaaaacgcccacttttactttccagagctgagaggcggccccgggccccgaactcccctggcccgacgctcccaccccggcagataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaatacattggctggctgtgaatgggcggacagaactactccatgaccttgtgcagcatgtcagtgatgttgatgttgaggatgccatggggcagacagcactgcatgttgcctgccagaacggtcacaagacgtcaagtagtgaactgtaataacgttcttttttgaggatggctgtttttcttgaagttaataattgggtttgctcagttttctttgtatgaatcagc

SEQ ID NO: 464806 - DNA, 1165 bp, Homo sapiens
  misc_feature (115)..(116): n is a, c, g, or t
  misc_feature (123)..(123): n is a, c, g, or t
gaatcaatcttgcaccccctccctcctgttacatatggtatctgttcatgttcctcactgaggcctctcttaagcactgggctccatcctcacttccctgttcacaaaggaatgnntttccanaagcttaggagtacgcccagtcgctgcgtggcttcccgcatactcagccctgcgcccgcgttggcgtggcctgggcgcccccaacgtgactccgcccagggcgctccgttctgccagctggaaactacagttcccagaaggccacgcgagcccgggagggacgcggcggcgggggctgcaggaaaggcgcgagcagaggcggcggcgggtgtactgtaggtggtcggtccggcagcagcccggcccccggacgcaggacgtggccccaggcagccctcgcagctcagtgctctagccggggcaagcccgcgtctccgcctgctggacgggcccaggcgagatgtagggctctgggcgcggaggccgccggtggggcggctgatcgcggaggatcgcggagggcgcgccgaggatggagagagcgatggagcaactcaaccgcctgacgcgctcgctgcgccgcgcgcgcaccgtggagttgcccgaggataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaatacattggctggctgtgaatgggcggacagaactactccatgaccttgtgcagcatgtcagtgatgttgatgttgaggatgccatggggcagacagcactgcatgttgcctgccagaacggtcacaagacgtcaagtagtgaactgtaataacgttcttttttgaggatggctgtttttcttgaagttaataattgggtttgctcagttttctttgtatgaatcagc

SEQ ID NO: 464807 - DNA, 1974 bp, Homo sapiens
tgagatacagccatgtccatagaagagttatgttctgatttcaaaaaatacttgtttcccaacagctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagccattgaaatgaatataaataagatgtggattgctagtgataattggtcaactgccaccaagattaccaccattcctaatgttaaaaagattggcaaagttgtagggtttgcctttagaagagggaatatatcctctttccattcctttcttcaaaatctgcacttgcttcccagtgacagtcacaaactcttacatgaatatgccatgcatttatctgcctgcgcatatgtcaaggacactgatttgagtcaatgcatattcaatcattctcaaaggactttggcctacaaggctaacaaggctatagaaaggaacttcgtcatgagaaatgacttcctctgggactatgctgagccaggactcattcatagtattcagcttgcagtgtttgcccttggttatgccattcgggatctgtgtcaagctcgtgactgtcagaaccccaacgcctttcaaccatgggagttacttggtgtgctaaaaaatgtgacattcactgatggatggaattcatttcattttgatgctcacggggatttaaatactggatatgatgttgtgctctggaaggagatcaatggacacatgactgtcactaagatggcagaatatgacctacagaatgatgtcttcatcatcccagatcaggaaacaaaaaatgagttcaggaatcttaagcccaaggactttgcccctgctatttcctttgcctataataattttctctgatgttcatgtggttaattttcttattcctttctgtcttttctaaaatgtcaccacctcagtgagagcttccctggacacttatttaaaaattgcaacatcaacctagtagttcttattcactgtcctatccttatttttctccttaacacttataactttctgtcattctgtacattttgcttattttaactctgtcagtcttgtcaactagaacttaagttcgacgagctaaatatttgtgtttcattccccactgtggcttcaacaattagaacagtgcctaacatatagataggcactcaacaaatatttggtgaatgaaagaatgaacacagtaatgctgtaaaccattttccttaatttgatttcccctggctgtaaaagttttagtaaagcaagatacttcttccttgaaagacagaaacgtagccattcttctgtgttctcaaactttcactgtcatcatcttcattttccttaccattatcctcacaactacattac

SEQ ID NO: 464808 - DNA, 793 bp, Homo sapiens
  misc_feature (755)..(755): n is a, c, g, or t
  misc_feature (764)..(764): n is a, c, g, or t
tgagatacagccatgtccatagaagagttatgttctgatttcaaaaaatacttgtttcccaacagctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagcaggatgcggcagccnccctttttnttttttcacttatgctacatctacaataa

SEQ ID NO: 464809 - DNA, 1384 bp, Homo sapiens
tgcctacatcaaaataggggaaacttcaaataaacaatctaatgatgcatccagctgggaacggtggctcacgtctgtaatcccagcactttgggaggccaaggtcggtcctgtcagccttctggccatcggggtcctcaccgtgcactgcatggtcatcctgttgaactgtgctcaacacctcagccagagactgcagaagacttttgtgaactatggagaggccacgatgtacggccttgaaacctgcccgaacacctggctgagggcccatgcagtgtggggaaggtacactgtcagcttcttattagtcatcacccagctgggcttctgcagtgtttattttatgtttatggcagacaatttacaacagcaaccacactgcctgtcattgtgctttatgtcagatggtggaaaaagcccacgtgacctccaacatctgccagcccagggagattctgacgctgacccccatcctggacattcgtttctacatgctgataatcctgcccttcctgatcctgttggtgtttatccagaacctcaaggggattccatatcccagcaacctacccttgatggcaaactggaagaccttcttgctgttctttggtacagccatcttcacatttgaaggcgtcggtatggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggtatgtcctgcccacctcaggtgagatagggagagacactggaactgttctggttgtcatagcagagagcacagcaaagctgagccatgaagctggtaatccatcactggaagtgacatatgtctctcctgctcacactgcatcagtcaaagcaagccacatggccgcacctcactccaagggggcagggaagtgcaattctgccatgtgcctggaagtatttggtgaacagcacaaataactgctgtgctacctgatgcagtgaccgtggggattaattggattaatacatagataatgcttagaaaagtgcttagcacgtggtaagcattcatgagcgttagctattatcattgttatgcatccccacagccttcatttttccaaggtgagtaggatgatggtgcatttatttcccacaaatccagagctgtagaatgagaaaaatgtaaccatccccacccaccttgctgtgttatgataatgactagatgagacaataaatgtggagtttctttgaagttgtgccttattttactcaagatatcatcctaatatgctgttcttgtt

SEQ ID NO: 464810 - DNA, 1502 bp, Homo sapiens
tgagctgtgggagggccactggtccaccacagggagtctgtgctgtccagtgcccactggatggcaggaagggtagggccttagggtttttctaggccttcgggacacagaagtgatctagacagatgggccttgccttggtggaatttgtaactaacaggatgagagatattaatcaagaaaccacacagtcaaatatttcacagcagaggaacgggtgctctgaatgaggggtatgagggtggtggcagtcatgaagaagatgtgtcagaactgtgacgctgaatccggagccccaacctctcctagcctcctagaggaggatgacccaggacccttgtcctcccaacagcaggccaccagttcaagggacaagaagcccctaagctccctccacctttcacatagggcccaggtggccttggagtacctgcctttcttctgcacctatgggtgcctcctggaagaggaggggttggtcctgcagcccaagacaccgctccaggaggactcagaactgctcagtgggttcttcccttactaccgctctgaggaggagagtttgcccagcctggcccttcctggctggtcacacaggggctcccaagatctgcccactgagaaggaggcacgggctggctgcttctgcaggacaacagtcagggacgaatgctctactctaacaggcccctggacaggcccctctcagggctgctgcggcccttggagcaaggtgtcactggttgggagcacagacactgcaggaagactgtcctgttcaagcccagcttgaccacctgctaggagagcggcctggggaacgtggtttccttataaaagagagaacagcagcagcaacaataaagccattgtgagaattacatacaaccacgtacctaaagtgctcagcaggatggtaaggatggtgactctgcatgtgtctgctaggccctacctccttggaccttgtggacctgttttctggtgctccagcccaacttccaaccccaggctcacctggtgagtggctgaatcacactgggattttgagagtatatgctcatcccacctaccccgggaccagacacttagatgctgattcctgtttgaaaatcctttagtgccagccacactggcatgtcccaagttcacagcctctctgtcccgtggcgctggttttgtgtctcctccccgggtgtaggttctttgtttgctttgacactcacacacctctgaccactggatccctgctcctccacccgatggctgcttgtctggaatgccctcacctgctcacatgcttcctgaggatgaggactttaagaaagagagagaaatcaatcggtcacactagagttacatcaaagaaattctttttagaaaatctattttttactatttccaaggcactcctatgacttcccattgggtttggggatttgggatttggagtatgatgggagtatgaagaaataaaggtacccttgccaggaaaactcgtc

SEQ ID NO: 464811 - DNA, 1743 bp, Homo sapiens
gatacccttaagggagaactctggagcactaactgtgtgttccctacagatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464812 - DNA, 4687 bp, Homo sapiens
attagcatagtagaggctcggtgtgtagatccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaagagcacttgagggaccccctgacctccctgagccacactgagctggaagccgcagaggtcatcctggagcatgcccaccgcggggagcagacaacctcccaggtgtgtgtcctggagtggggagcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggctcccacttataagtgagaacatgcaatatttggttttctgtttctgagttagttcacttaggataatggcatccaactccattcatgttgctgcagaggacatgatttcattcttttttatggctgtggaatgcctgccttttctaaaactttctggtacttccaccttgtccacaaggagtctccctccctggagttaccaccatctccaccaccccaagttcactttgcatgacttagcacttagtcatttattgtgtttgttgaggtttcattattggtttcttgacagccattgggggtgggagcactatgcatcctatctcccttagttttgtaccttgagcagagctgattatacagcagttgcccaataaatgttgaggacagtggatagagtgatggattttatggtctaggatggtgaccattaatttaacaaatatttatagaatgccactgtcctaagtgctggagatacagcattgaacaaaacaaagtctgaagactgacttgtggttcttatttccagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgttagtgaccatatgttcttcctcccagggctgtttgct

SEQ ID NO: 464813 - DNA, 5480 bp, Homo sapiens
attagcatagtagaggctcggtgtgtagatccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagtcattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacccctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggattcaggaggtacatgtgcttgtttgtcatatggatatattgcatactggtggagattgggcttctagtgtacctgtaactcaaatagtgaacattgtacctgataggtaatttttcaaccctcgcccctgcctctactcctacctttgccccctttggagtcctgggagtctgttatttccatctctatgtccatgtgtacccgttgtttagctcccacttataagtgagaacatgcaatatttggttttctgtttctgagttagttcacttaggataatggcatccaactccattcatgttgctgcagaggacatgatttcattcttttttatggctgtggaatgcctgccttttctaaaactttctggtacttccaccttgtccacaaggagtctccctccctggagttaccaccatctccaccaccccaagttcactttgcatgacttagcacttagtcatttattgtgtttgttgaggtttcattattggtttcttgacagccattgggggtgggagcactatgcatcctatctcccttagttttgtaccttgagcagagctgattatacagcagttgcccaataaatgttgaggacagtggatagagtgatggattttatggtctaggatggtgaccattaatttaacaaatatttatagaatgccactgtcctaagtgctggagatacagcattgaacaaaacaaagtctgaagactgacttgtggttcttatttccagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464814 - DNA, 4841 bp, Homo sapiens
attagcatagtagaggctcggtgtgtagatccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagtcattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacccctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggattcaggaggtacatgtgcttgtttgtcatatggatatattgcatactggtggagattgggcttctagtgtacctgtaactcaaatagtgaacattgtacctgatagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464815 - DNA, 5952 bp, Homo sapiens
tgaattcactcagggctggggcttcatgatcttacaggccccggtctacaattaacagaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagtcattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacccctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctgggggtgagtggaaggaactgggagccttgggaggctaacagacaggaagaaggaggaagcttggactcccaggtcacgctctggtcctctccgtgccttcaggcatcttgcttggtggagagcacttgcctgggctctggagccaggctgactggttcaggtcccgctctgtcatctccaagtgtgtggtgggattctgaacctgtcttggcctcagtttatgttctttatgaggtaaggaaaaggtactagcttattgaattcttatgagagttaaaaaagatgcctgtggactacacagcattgtgcctggcacacagtaagtatgcagtcactgttattattttaaaaattagctaacttctctcacggtgtcctcccaatatgcaccttttgctcctagtgtccagatacctagctttgtatcattattttttctgatgcccactttttttctttttttaaatgtctatagcagttttattttattatttattttagattcaggaggtacatgtgcttgtttgtcatatggatatattgcatactggtggagattgggcttctagtgtacctgtaactcaaatagtgaacattgtacctgataggtaatttttcaaccctcgcccctgcctctactcctacctttgccccctttggagtcctgggagtctgttatttccatctctatgtccatgtgtacccgttgtttagctcccacttataagtgagaacatgcaatatttggttttctgtttctgagttagttcacttaggataatggcatccaactccattcatgttgctgcagaggacatgatttcattcttttttatggctgtggaatgcctgccttttctaaaactttctggtacttccaccttgtccacaaggagtctccctccctggagttaccaccatctccaccaccccaagttcactttgcatgacttagcacttagtcatttattgtgtttgttgaggtttcattattggtttcttgacagccattgggggtgggagcactatgcatcctatctcccttagttttgtaccttgagcagagctgattatacagcagttgcccaataaatgttgaggacagtggatagagtgatggattttatggtctaggatggtgaccattaatttaacaaatatttatagaatgccactgtcctaagtgctggagatacagcattgaacaaaacaaagtctgaagactgacttgtggttcttatttccagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464816 - DNA, 5730 bp, Homo sapiens
attagcatagtagaggctcggtgtgtagatccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagtcattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacccctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctgggggtgagtggaaggaactgggagccttgggaggctaacagacaggaagaaggaggaagcttggactcccaggtcacgctctggtcctctccgtgccttcaggcatcttgcttggtggagagcacttgcctgggctctggagccaggctgactggttcaggtcccgctctgtcatctccaagtgtgtggtgggattctgaacctgtcttggcctcagtttatgttctttatgaggtaaggaaaaggtactagcttattgaattcttatgagagttaaaaaagatgcctgtggactacacagcattgtgcctggcacacagtaagtatgcagtcactgttattattttaaaaattagctaacttctctcacggtgtcctcccaatatgcaccttttgctcctagtgtccagatacctagctttgtatcattattttttctgatgcccactttttttctttttttaaatgtctatagcagttttattttattatttattttagattcaggaggtacatgtgcttgtttgtcatatggatatattgcatactggtggagattgggcttctagtgtacctgtaactcaaatagtgaacattgtacctgataggtaatttttcaaccctcgcccctgcctctactcctacctttgccccctttggagtcctgggagtctgttatttccatctctatgtccatgtgtacccgttgtttagctcccacttataagtgagaacatgcaatatttggttttctgtttctgagttagttcacttaggataatggcatccaactccattcatgttgctgcagaggacatgatttcattcttttttatggctgtggaatgcctgccttttctaaaactttctggtacttccaccttgtccacaaggagtctccctccctggagttaccaccatctccaccaccccaagttcactttgcatgacttagcacttagtcatttattgtgtttgttgaggtttcattattggtttcttgacagccattgggggtgggagcactatgcatcctatctcccttagttttgtaccttgagcagagctgattatacagcagttgcccaataaatgttgaggacagtggatagagtgatggattttatggtctaggatggtgaccattaatttaacaaatatttatagaatgccactgtcctaagtgctggagatacagcattgaacaaaacaaagtctgaagactgacttgtggttcttatttccagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagactggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464817 - DNA, 4314 bp, Homo sapiens
ggcttcctccagttccggagtccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464818 - DNA, 5978 bp, Homo sapiens
attagcatagtagaggctcggtgtgtagatccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagtcattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacccctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctgggggtgagtggaaggaactgggagccttgggaggctaacagacaggaagaaggaggaagcttggactcccaggtcacgctctggtcctctccgtgccttcaggcatcttgcttggtggagagcacttgcctgggctctggagccaggctgactggttcaggtcccgctctgtcatctccaagtgtgtggtgggattctgaacctgtcttggcctcagtttatgttctttatgaggtaaggaaaaggtactagcttattgaattcttatgagagttaaaaaagatgcctgtggactacacagcattgtgcctggcacacagtaagtatgcagtcactgttattattttaaaaattagctaacttctctcacggtgtcctcccaatatgcaccttttgctcctagtgtccagatacctagctttgtatcattattttttctgatgcccactttttttctttttttaaatgtctatagcagttttattttattatttattttagattcaggaggtacatgtgcttgtttgtcatatggatatattgcatactggtggagattgggcttctagtgtacctgtaactcaaatagtgaacattgtacctgataggtaatttttcaaccctcgcccctgcctctactcctacctttgccccctttggagtcctgggagtctgttatttccatctctatgtccatgtgtacccgttgtttagctcccacttataagtgagaacatgcaatatttggttttctgtttctgagttagttcacttaggataatggcatccaactccattcatgttgctgcagaggacatgatttcattcttttttatggctgtggaatgcctgccttttctaaaactttctggtacttccaccttgtccacaaggagtctccctccctggagttaccaccatctccaccaccccaagttcactttgcatgacttagcacttagtcatttattgtgtttgttgaggtttcattattggtttcttgacagccattgggggtgggagcactatgcatcctatctcccttagttttgtaccttgagcagagctgattatacagcagttgcccaataaatgttgaggacagtggatagagtgatggattttatggtctaggatggtgaccattaatttaacaaatatttatagaatgccactgtcctaagtgctggagatacagcattgaacaaaacaaagtctgaagactgacttgtggttcttatttccagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464819 - DNA, 5997 bp, Homo sapiens
cggcccacagatgatgtatgaggccggaccgggtgtaagtacactagtgggggctcggcgcttgaattgaactgtgagatgcacgcctgcgcgccgaaaagagaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagtcattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacccctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctgggggtgagtggaaggaactgggagccttgggaggctaacagacaggaagaaggaggaagcttggactcccaggtcacgctctggtcctctccgtgccttcaggcatcttgcttggtggagagcacttgcctgggctctggagccaggctgactggttcaggtcccgctctgtcatctccaagtgtgtggtgggattctgaacctgtcttggcctcagtttatgttctttatgaggtaaggaaaaggtactagcttattgaattcttatgagagttaaaaaagatgcctgtggactacacagcattgtgcctggcacacagtaagtatgcagtcactgttattattttaaaaattagctaacttctctcacggtgtcctcccaatatgcaccttttgctcctagtgtccagatacctagctttgtatcattattttttctgatgcccactttttttctttttttaaatgtctatagcagttttattttattatttattttagattcaggaggtacatgtgcttgtttgtcatatggatatattgcatactggtggagattgggcttctagtgtacctgtaactcaaatagtgaacattgtacctgataggtaatttttcaaccctcgcccctgcctctactcctacctttgccccctttggagtcctgggagtctgttatttccatctctatgtccatgtgtacccgttgtttagctcccacttataagtgagaacatgcaatatttggttttctgtttctgagttagttcacttaggataatggcatccaactccattcatgttgctgcagaggacatgatttcattcttttttatggctgtggaatgcctgccttttctaaaactttctggtacttccaccttgtccacaaggagtctccctccctggagttaccaccatctccaccaccccaagttcactttgcatgacttagcacttagtcatttattgtgtttgttgaggtttcattattggtttcttgacagccattgggggtgggagcactatgcatcctatctcccttagttttgtaccttgagcagagctgattatacagcagttgcccaataaatgttgaggacagtggatagagtgatggattttatggtctaggatggtgaccattaatttaacaaatatttatagaatgccactgtcctaagtgctggagatacagcattgaacaaaacaaagtctgaagactgacttgtggttcttatttccagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464820 - DNA, 5306 bp, Homo sapiens
catacgccatggctgactctagaggatacactcctgtcctgccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagtcattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacccctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctgggggtgagtggaaggaactgggagccttgggaggctaacagacaggaagaaggaggaagcttggactcccaggtcacgctctggtcctctccgtgccttcaggcatcttgcttggtggagagcacttgcctgggctctggagccaggctgactggttcaggtcccgctctgtcatctccaagtgtgtggtgggattctgaacctgtcttggcctcagtttatgttctttatgaggtaaggaaaaggtactagcttattgaattcttatgagagttaaaaaagatgcctgtggactacacagcattgtgcctggcacacagtaagtatgcagtcactgttattattttaaaaattagctaacttctctcacggtgtcctcccaatatgcaccttttgctcctagtgtccagatacctagctttgtatcattattttttctgatgcccactttttttctttttttaaatgtctatagcagttttattttattatttattttagattcaggaggtacatgtgcttgtttgtcatatggatatattgcatactggtggagattgggcttctagtgtacctgtaactcaaatagtgaacattgtacctgataggtaatttttcaaccctcgcccctgcctctactcctacctttgccccctttggagtcctgggagtctgttatttccatctctatgtccatgtgtacccgttgtttagctcccacttataagtgagaacatgcaatatttggttttctgtttctgagttagttcacttaggataatggcatccaactccattcatgttgctgcagaggacatgatttcattcttttttatggctgtggaatgcctgccttttctaaaactttctggtacttccaccttgtccacaaggagtctccctccctggagttaccaccatctccaccaccccaagttcactttgcatgacttagcacttagtcatttattgtgtttgttgaggtttcattattggtttcttgacagccattgggggtgggagcactatgcatcctatctcccttagttttgtaccttgagcagagctgattatacagcagttgcccaataaatgttgaggacagtggatagagtgatggattttatggtctaggatggtgaccattaatttaacaaatatttatagaatgccactgtcctaagtgctggagatacagcattgaacaaaacaaagtctgaagactgacttgtggttcttatttccagacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtgccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 464821 - DNA, 1525 bp, Homo sapiens
aggtagtcgggagaatcctgactcggggtgcggggtttatgaatgggaagagctttgatcctaaacttaagataattcatactggagacaaacccttcaaaggtgatgaatgtcacaaagcctttaaccagttctcaacccttaccaactgtaagagaattcatactggagagaaaccctacaaacgtaaagaatgtgggaaaggttttaaccagttttcacaccttactaaacataagaaaactcatactggagagaaaccctacaaatgtaaagaatgtggcaaaggttttaaccagttttcacaccttactaaacataagaaaactcatactggaaagaaatcctacaaatgtgaagaatgtggcaaagcttttaaccagtttgcaaaccttattaaacataaaagaattcataccggagagaaatcctacaatatgaagaatgatgaaaagcttttacccagtcctcagaccttactgaacacatgagaaatcatacaggagagaaaccctacaaatgtgaagaatgtggcaaatgttttaatgggccctcctaccttacctgacataagataattcatactagaaagaatacctacaaatgtgaagaatgtggcaaaagctttagtgtattctcaacctttactaatcataaagcaattaatactggagagaaatcttacaaatatgttgaatgtgacaatgtttttaactaggctgcaactcttgctgatcataagaaaattcatacgggagaaaaaccccacaaatgtgacaaatgtggcaaagcttttaactgctcctcaaaccttactagacataaaaaaattcatactgatgagaaactctacaaacctaaaagatatgacaatgattttgacaacacctccaacttttctaaatatacaaaaaatcatcctggtgaaaaacctttaaaatgtgaagaatgtgtgaacactgatttttttctatagaagagtaagggcattaaagcttaagatttataatgaaaatctaagtaggttcttggtggttaacttataatactgagtgatgagggggtgtaaagttcagtctacagtgttcattcttagtcacctaactgtagccaactcccttgtcattttctctggaaaaattttgggatcatggcagcttttggattaaaatattttctgttaatttatgagacactgccattggggctttaagggaactgtcagtgggtgaggccttttttaagtcagattctggactgccttctgttgagcgagtgtgaaagggcacaggtctggtctgggaagttcagagaggacagggtagagtggtgctgtaggtggaggtgagggtggtgcgaagggggaagtaagggattttgagtgttttttgagagacataagattagagagttcctgattagtagttctaagttgcttgttcgcctcctgtagggaggtgaggcagtctttgccccgtttgctactctccaaataccactaaaaataactctcccattctggccg

SEQ ID NO: 464822 - DNA, 868 bp, Homo sapiens
  misc_feature (15)..(15): n is a, c, g, or t
taactggtaccagangtgggaagaagacaggaagatgtgggaaagtttggaacttcctagagacttgctggataattttaaccaaaatgctgacagtgatatggacaatgaagtccaagctgagatggcttcagatggagatgaggaacttattgggaacgggaagggtgcaggctccaagccttggtggcttccatgtggtgttgggcctgtggtacgcagaagacaagagttgagctttgggacggtttgccaatttcagagaatgtatggaaacacctggatgtccaggcagaagtctgttgcagggtggagctgtgagagagggccaccatcctccagagcccagaaagggagatccatcgatagcttgcatcatgcacctggaaaaaccataggcattcaacaacagcctgtgaaagcagttcaggggttctaattaccatgtgccaaaacaagactgcagaaagtataatctattagcaataacttgtgtctaacaatataattgcatctggaataatgaaatgttctttttagtatcaaaattaataatgtcatatcaatgccattaataattaaggattctttttataacattgaatcattaataacaactgcattatgaacaattctattaatatcaacactaaaataatatcatattgtctttccatagttacaattttgcaagtataatgaaatgctgtacacataatggactagaccctgctgtgtccaaggtaagcaatcctggaaatatagtacccttttagataaataaactatatttttgttttcctagacagtaatatgtagatagaaaaattcatcattaaaaacttagaaaccacatgaaaattctgtt

SEQ ID NO: 464823 - DNA, 5036 bp, Homo sapiens
  misc_feature (15)..(15): n is a, c, g, or t
taactggtaccagangtgggaagaagacaggaagatgtgggaaagtttggaacttcctagagacttgctggataattttaaccaaaatgctgacagtgatatggacaatgaagtccaagctgagatggcttcagatggagatgaggaacttattgggaacgggaagggtgcaggctccaagccttggtggcttccatgtggtgttgggcctgtggtacgcagaagacaagagttgagctttgggacggtttgccaatttcagagaatgtatggaaacacctggatgtccaggcagaagtctgttgcagggtggagctgtgagagagggccaccatcctccagagcccagaaagggagatccatcgatagcttgcatcatgcacctggaaaaaccataggcattcaacaacagcctgtgaaagcagttcaggggttctaattaccatgtgccaaaacaagactgcagaaagtataatctattagcaataacttgtgtctaacaatataattgcatctggaataatgaaatgttctttttagtatcaaaattaataatgtcatatcaatgccattaataattaaggattctttttataacattgaatcattaataacaactgcattatgaacaattctattaatatcaacactaaaataatatcatattgtctttccatagttacaattttgcaagtataatgaaatgctgtacacataatggactagaccctgctgtgtccaagatggtttgctattaccagcaatgccacttctgggtatctgttcaaaagaattgaaagcaggatctcaaggagctacttgtgtatccatgttcctggcagcactattcacaatatctaagaggtagaaacaaccaaaatatccattggcagatgagtggataaacaatatatagtatatatgttcaatgaaatgttattcaaccttaaaaaaagtaaatcctgcaatgtgtgacaacatagatgaaccttgaggacattaaaataagtgaaataaatcaatcacagaatgacaaatattgcatgataccacttatatatcttaaatattcaaattcacagaagcaaataatagaatggtggttgccaggagctggaaagagagagaaatggggagccctaatcaagcgatataaaatttcagttaaaaaagatgaataggttctagaggtctgctatacaatattgtgcctacaaatgataatactgcattgtatactttttaagctgttaagagggtaggttgcatattaggtgttcttacaattttttcaaaaaaattaactcaatacaaaaaataatgtaaaagaagcataaaatatatctaagaaaattaggaaacatgagtaatataaggtaaaaccaagacatcataaaaacaaaaaaaaaatttaatgaacagggtaatagggattaaaaaataaagaatgtaaaacaaatttttgagtcctaagaccagattagagaactccgtcagaacgtaggaagaaggggtaaaaatatagaaacataaaggaaaacaggtaagagaataggagtaatcagaggatatttgaaaaattatcaaaactatttatttcacaataatactagatggatgatcttaaatacaatgggctcatagattgctacaggagtggtaaggaagcaaatacacatatggacacattctatattgagaatatcaaagaaaaatgaataattataaaagtttctacagagaaaaagtagattgcctacacaggaataataatcagaatgctgtcaaatttattaaagcaacactggatacaaaaagaacaagatatcatatttttaaagtattaatggaaaataaactttgaacttagaattttatatacagccaaaggttcagaaaagattttctttggtaaaaaataagaaaggcctcatagatttaacattaactgaaagtctaatatcaaaaacactaatgtgatataggcttcaagaaaaaaaaaactcacgagggtacttccaaagatacagagagtaaggataatcaaataccttgtaacaatgtattaataacatgactttaagttccaagttggggaaactaccatgctatggacagaacgtttgtgttctcccaaattcatatactgaaagtctaatccccaaggtgatgatatttgtaggtgaggtctttgggaggtgattaggtcataagggtagagccttataaaaaagagacaccagagaacttgcttttttctctctttctgcacaatgcaatgtgaggatacaagaagacagctatctgaaaaccagaaaacaggtcctcaccagacaccagatctgcttgtaccttgatcttagacttcccagcctccagaacttcgagaataaatttttggtgtatatgccacctagtctgtggtattgattgtattttaacagcctgaactaagacatgccataagagcaaatataaatatataactttaaaatagtgaaataaaacccacacagtgaataatacacacacaaacgaaagtttacaaatgaaaatatatttgaatgtttgcccatgaaagggaatgggaatgggaaataggggtaaaaggagtaaataaatgaatgaagcaagataaagctttgaatgaatcaatgtcaattatgaaccatagataattgtgatcaattctaccctttgcacctgaagtccaaacaaaatacacatatgaataaaaagaatggaaagaatgatgatgcttttcttttctttaaaaattaagccaggtattccctaaaactcagtttccaaatgtacttccattgggttttatttgcagcatatgaatacctacaacagtaagccctctgaatataaataaaatggtttgtgattctatgaaagtttgatgagtgactcctaggacaacaaaaaacaacactgacctgttctctgcctgaaaaaaaatgaccaaagtgactctcaatgctttatgatgatgaatcgtgcttaaaaacacagccagtttctatgagagggagttttattgcttgagctaatgggcactgacattttgcttctataaaatattatatagggttttccaagaacccgagagattttgttttcctattgcaaatccatggaaagcaaactgctataagtagatgtggtgcctctgcaggtgaatgatttctgaatattggttttttaactggaaggggaattctaatcttggtggtgctgggaaaatcattttagatatttatgtctagtgttccattattggaagactaagcatgtaagagttatttatatcctactgcttaaggtcttcaccaaggtctgatcgcaaaaattcaaaaaattgcaacctctggcataaaggcgttaattttttccccattttcccatctgctaagtcattttaacactagtgtttgaagtgaaacaaacttatcttcttagaatgagttggttttgttaaggaaggctgccacacaagaattctggtttgtgaatcagtgtaatatccaatgtaaaacatgaactgaggggtacaaacacttctttactgagcaatgtctcttttttaaatctttattattattattatactttaaattctgggatacatgtgcagaacatgcaggcaaaacaaagaatcaagatgccataaatatgtcaataaacccagttatccaacataccaatggcaatgcagatataataaaaagacaagcatctgagaaatactttaaggtatataataaaaaattaatttccaaaatatagaaatacctcctacaattaaaacattatagaaatatctaaaattatgtaaacagtaaattcataaaaaatgaataaaagtgatgacaaacatataaaattatcttcaccctcactagtactcaggaaagtgtaaatgaatatcctgaaattaaatagtggtcaaatagaatatcaaaacctaaaaacactgataatagccagtgatgaaaaagatgcacagaaaatgcatcatcttatttactctcagtgggaataaaaatatatgcaggtctttcaggggctaatttggtaatatctattaaaatttaaaatatatctatttatccccaaattctgtgtttagatatctattttagagaagtacttgtgcacaaaaagccatgtacaagaatattgatccatttttataattaaaaatacatataaacattcatctataggcaatgaattcttaaatgtcatatgatacagcattagtctggaaaactatgcaacaggtaaaaagttgaagagaatatatgtttgctcatgtgtcttttaagtcagaaaaacacagcacactccaaaatatatacacaatgtattttaacatacaaaattaaacacaaaaaatcaaaattttacctttataagtacatagaaatacatttataagcagaaaaaatggactgaatgaccatatgaaattgaagggagtagcaatgaaaataatgtttgagaaagaagaatcaagaacattactaattagaattcatttatgtgttcttttgtaaataaaaataagaaaaatatgtaaaaatgaatacattaaaaagaagacaggatacatatatcaaaaaaaaaaaccacgtatcaacctcaaaaaatcccacttacaaaagctattttcaagatcttctcttggttttggttttcaaaactttttctatcatggagctagttctatcatggtagtttgtattttcctgattagtttctgaaaaattgatgtacttgtggcttgatgtttcttgtcagttttgaaaagcttgattaggatagcctccaatactgtatttttttcttttagagtttgttctgatatgttactagtgttttacattatttatttttatatttatatatttttaacttttaagttcaggtatgcatgtgtaggtgtgttctatgttaaatttgtttcataagagtttgttgtacagattgtttcatcacccagatattaagcctagtacccattc

SEQ ID NO: 464824 - DNA, 1947 bp, Homo sapiens
tattgtgtcaattaggaatcagtaagcgtatatgttaattaggaaacagtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggtaaggtttgaattgaggtggccttatccctagtgcttgtgagtgaccttctagaaaggaactgtgagctctgggtttctgtgtcccgctggccattgttttgggcctgctagaaaatgcccatgggagaaagtaacctctggccttacttgggacagttgtcaccagcaagagaaaagttgattacaacagagaggcagtcaggagacagttttatttttgtccccacatgcctattaaacatctatcctcctatcgacatgagtttcctaatcttttaaaatcaagaagaaccatggtgtccaatttaaaggatttgattaaacataaaggagttttaacctggaaagttctgtatttacagtctgtagtctctacttccacacttgtggaagggtagtgttgtttatatatttttaaaagttacttttagtgtacatacagtaacattcacttttttggtgtacattcctgtaagtttcaagaagcatgtagaggaataaatgcaccaaagtcagaatgcagaacaattctccttctgttctctgcctgtactgtcttctcttttccaaaatgtcacatatatgggatcatacagttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttatcaaccagcctaccaacttccagacacgagtaaagccatcctagactatatccaaccccagtcaggctgacacagaccataagaattgtacagataatccacagaactgtgataaataataaagatgtttgtaattttaatacataaagagtgggaagttttatgcagcaaaagataactgataaatcattctaaagaggatacactgattaatgagaaaagaatccctgctctcaagcagccagtctgctgtccattggggaagagttaacagaattactaaaattgagaaaacgcacctagataaataaatagatgttgaagatctatagtcccaaaaggtggggagaggagagtttctcatcaaactctccgtggtttac

SEQ ID NO: 464825 - DNA, 622 bp, Homo sapiens
tattgtgtcaattaggaatcagtaagcgtatatgttaattaggaaacagtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggtaaggtttgaattgaggtggccttatccctagtgcttgtgagtgaccttctagaaaggaactgtgagctctgggtttctgtgtcccgctggccattgttttgggcctgctagaaaatgcccatgggagaaagtaacctctggccttacttgggacagttgtcaccagcaagagaaaagttgattacaacagagaggcagtcaggagacagttttatttttgtccccacatgcctattaaacatctatcctcctat

SEQ ID NO: 464826 - DNA, 493 bp, Homo sapiens
gtgagtgcacaccatgcacctgcccactccactgggcagggtttttttatcaaggatagactgagctttagatacctggagccaaccctgtaggtgggtaagagtgttatgagagacatgcatctcactgtagcatttcttctacaaggatgtctccgtgcagtcccattcttctgattgtctccttgttcatgttctttctccaaatatctatttttatgtcaaattctggcttttttaaaaaaatgtgcttgcaaggaaaacatcttggttggtgaactgtagaccattcctataatggttggctggcagcaaaaggcaggcgaaaacagattcttgtactacagctaaaagttattgcgttacccatagggtacaatttcaggtacccaataggaaggcaagaaaaaaaaaatctaatatttagtcacagagatatacatagagagtctcaaaaaccataagctttcaataagtgtcttgttactaattt

SEQ ID NO: 464827 - DNA, 667 bp, Homo sapiens
tattgtgtcaattaggaatcagtaagcgtatatgttaattaggaaacagtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggtatcttcatgggctgtcaggtggtggggactcaggaatgggtggaaacgtataggtcacttcctcctcccttccacagctgggaaactgaggtctagagagcctcccacagaagaagcagaattgtcattgga

SEQ ID NO: 464828 - DNA, 832 bp, Homo sapiens
tcttttctattgcgcttgtcaaatgccctggagaagacttctagttgtctgcctagggcatatgtgtctgtgtatgcgtgtgtatgcactcacaagagtgtgtgtacttagcaaacggtattccagcctagaaaaggttaagaaatatgaagggtttttgcatttagtgtgtaagctcaactcccctctttttagttcgaaccctctgtgtgtctgtctgcaggaaattaatctcttagatcttctgctaagatggttagttacctgttgcatgaagtggggaggagatgagaaggtccagctgcttcttcagcaactctccttgcaacagaacttccagagatatttgaggatgcccattgttggatctgtatttgaaattaaaaacaaaacaaaacaaaaaaaatcagtctgcttctcagctctctctgcagttggctgagaatccaactttctcagatcttctcccagcttccaaatttctgttgctgttgtctccattcttgtttattttatctttgatatgggtcaatgacagtgtgggaagaaacaagaaaaatcaataacctacattttaatgtgaaatgacaacatgtttaacaacagacttcccaggcatgcttcaggagagaatgcgagaacataattttagaaccagaaggaaacttagagatgatgagaacttaacactggatttcacaggtgagaaatggagaccctgactggagaactttcttgggtcacacaactagttatccactttcagcttggtcttctttcaatcttcatttgcctcctaaataaaagatctgctggctcggactcaatgttt

SEQ ID NO: 464829 - DNA, 5539 bp, Homo sapiens
gaagacctccccttcacatgaggcccagctgcactttggcatggacccagctaccagctatgcttgtcatcctgtggctgccctcagctactcctgtgcagaagtcaggattgaataaagctgtgctacaaactgtacagcacaagggatactcgaatgtcgtaaatcatttcaatgaaaatcagtctttctctgttaattcattaggcaaaaatgatgtgagattccgggccctgaagcccagccccacagcctgccgatgggacaggtgtacacctccacttgaggcaggatgtacctctccctggacacctctccccaaaccactaacatgggtgtgctccaagtcctggcccttggaggacttccccaccctgctttgcaagattgttccagttctggcttattggacaacatggaaagcaaaccttggtggtgaatgtatctgtttccagagtggaattcatgccagttgcagcatggagctgagaagacaagaaacttctctaggtcttgtgggcaggagtggttcccggttttctggggtcctgatgatttcccaggtccctttaagaacaagaatataaaattctcttttgtttgttttcatgttgatccaaattaaaaatagctttttttttcatttgatgagagtgttttattgttgccgtgttttatcatatttgaagagaaacaaaaagttaattttatggcaatcccaggctttgataaacaacgatttctgttctcacagcatgtgtagcagtagataataagcctgccaccattcaattgaataaacgcatcagttgacagtaagatcaataagagatattaaacccttttcccaaatacacacacacacaccacacacacacacacacacacactcatattccacaaaggcatgtaaactaaaataataaaaataactttttgattacataaatgataaatgattattgtagaaagaccttttaaacagtatagaaaattgtaaagaaattacagtgatctggaactgtgctagccctgtctgttgatgctgtgttgaggcccatgcttcttgcatctctttgtgtgcatgagtatattcaccctcacctttcacctcgcgcttctccacctccatcccccaggctctttatataattatcttcatggtcatagaactatatggggttatttgggtagctacccacacacatacatgattgtatttttgtcattgtttattctaaaaaaatagaatccttattccatgcacttttgctaggacttgcatatctcattatagatactcctcgagccttttggcatagatctagcagattctttttctgttagatctatgccaaatgaagcatagatgatgcgtgttaaacatacagaaaagaagatattttacagaaaacacccttatgcccactacctcgattctaccattaacctattacttatacttattttccatctatccatctctgtaaccatccaatccatcttattttgggggaatgtatttcaaggaaagttgcagacttctcagcatacttccccctaaacactttgcacacatgccattagctagtgttcaatatttttttccttcaaggtaaattttatttacattctaaagcactaatattgagcaaattatttgatgagtttggatgatggcatacatttgtgtaaccgaaatccctattgagatacagagcaacactataaccccaaaaggtacccttgtgcccccccacccaatgaattcccaattcccccacccagggacaaactgtattctgatgtttcctaccatagattagttttgctgcgtctaaaacttcatatatatcatatatgaagtcatgatatatatgaagtccttacaatatcagggtttcttcccagctttttctccccttgagcagtattccattttatgaatataccacacttagtttgttcattctctcattgatagacacctgggctgttttcagattggtgctattatagagaaagctgctatacaactcactctttttagtgactatataatatttcaatgtatgcatttataaaatttattcaagtatctattttgatatttatttagtcctctctttctttcaaaactttttggctactatgcgattgctatgatgtgaaaatctttgacccatgatgcttttattttcatagactagatttttggcagtgggcttgctaggttgaacagcatgtatttctctaggcttgtttgaatagatgttgtcatgcttttgcagcaaggcagccgctgctgacatttccagcagaagtctgtgagtgctcctaaccagcttccctgctggtgcagtgtcaccaagctcaaatgtttttccttgttgagagttactcattttcattttcctaagtaccaatggagctgagcatttttttatatgtctgctgaccatttgggtatgttctgcaaatcacttcatttcttttgcccattttacttttaggttgtatgtctttaacaatctgtgaaagctctgtgtatattatggacaattacctttatctacagataattccctttaaaatgtgcagtacagatatttgtacccagtgtatcatttttcttttgattttattagcactatatttttatcttagatatttaatttttttctgtaggcaatcaagtatatatataattatactctctatataaatacatcctctataaataaatatatgtgtatttctgtataccttctgagctcctaccacctttttttcttttcttctgttttgcttgcttgtttgttaaaagatctacctattctctaggtcatatgtatattctcctaaaatttactctaaattactgttattgttaattactttttttttaatacttaaacctttacttcctttagtgttagttttccatgtagtgtgggtggtgcttcaattctcttttgttccagatggagagccatttgtgccaacatcattcatttgataaactctacccaccaaactaaaataccaactgtaccatttattacactctcatgtaaatctagatctgtttctggattctctgttttgtctcattggcctgtttgcctttctctagatctgtttctggattttctgttttgtctcattggcctgtttgcctttctctagatctgtttctggattttctgttttgtctcattggcctgtttgcctttctctatgtcaatatcatttatagtgactttcttgtatgtcttagtagctggcaaggcaaccccttcaccccccaagtcctaaaaccttttatctttgttatctttgggcacttacttttccatatgaactttaagataactgtattcaactcacatttcccctgaatccactaggattaaattgaaattatatattaatttttagaaatattgacattttataatattaagccttcttccttcaataagattttacagttttctacacataccctgaacaacatttcctatcagattttgtcttcttttatagacttattccctgttatgaattagcatttccctaatatcaatttttagatctttaatatcagtatagaaaaaatgttaatgattttcatatgtttattgtgtacatagatccttaccaaattcttcaatgaattctaatggcattccccacccccccctttaagtgctgaattttatgtgtataaaatcgtattactagcgaaaaaaaaggtatctatactcttccaatgcttaaatgtactgttttctttccttatgtcattttccagactgctaaaactatgctgaatagcactggtgatgggggaacccctgcctgttcctgattttagtggaaatgactttagcttttagcatttttccacttacaatcatggtggtagttggatttgggtaaggatcctctattatatataaaatattccgtttctatttccatttaactgaggctttggtagaagcagctgtttcagttttataaaagttcttctggtctcagttggtatgtttatatgattcttcttcttgtggatataataaattatgttgatatgttttctcatagtgagcaccgggccattcttggtgtaaagctgacttgatgaaactctgttctttttagatgctgaatttcatgttaattttttattcagaattttagcacagtttttactcataaaagatatttatttatagggttatcttaggtactacactaatttttttatcaagttttgttattaagaacacattaattttagagaatgagttggggaaattctcatacacaaatacgtattacgttaaaattaaccgtaaagaaatattagtaggacttagctttgaagccagctgactctgggatctttttcaatggtaggtctttaatcattctttaaatgtctcctatggtagtaatatattaaaattttttcttcattcatggggagatgttggcattttgtatttgctagaaaattacaatttttttgtagatttcaacttcattgcctcagagttacacatgctactgacttattattcttataatcccttccatattcgtattttttcttccctgtatgctccccctgtttatgctccccctgtttatgctccccctgtttatgctccccctgtatgctccccctgtttatgctccccctgtatgctccccctgtttatgctcccactgtttatgctccccctgtttatgctccccctgtatgctccccctgtttatgctccccctgtatgctccccctgtatgctccccctgtttatgctccccctgtttatgctccccctgtttatgttccatcacacccatggagacctattttaattctttccaaataatcacctttaaaatttatattttctactacttttttcttatttttattaatttcagcaaatgtctttattgattctctctacttttaaaaaattttggctttattttcatagccttttttctaatttcttaagatcaagtagttagtactgctttagctatatctctacatataaatatatctagagagcaattattggattgctttctacatgtatttaattttaagttcaagttctaattttattaacatgattatgtagaaagatatattttggttcctaagtaattaaactatttttgctgttctttttattgtatttttctaattttattgcattatgatgagatactatcttgtccttttaaaattgatgtctaattctctgaggagtgtgttaaattcttctataatttttttttggggggaaacacatgtttgtgactgttatatagtcttaatcttgcttaatgttttaaaaagccctttaaatacctttaaactacttctttcttgaaattaatgttgtgattcctgctttcatcttgttgcctttgtctgaaatctctgcccgccccctgctacctctctgctcatgtgttctgtccatgtttaaaggctagccttgtgcat

SEQ ID NO: 464830 - DNA, 893 bp, Homo sapiens
tttcattgtctttttaaagtttgcatctcaaagtataagtcgcagaactgaacaggaaattccagcatgttcatcatggagaagtttgaagatgttctgctgctggctttgaagatggaggaagatggaggaaggggccacaaaccaagcaagcctcctctagaaattggaaacggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggttacaagaaaaagaaacggagtagcacaagacaaa

SEQ ID NO: 464831 - DNA, 1661 bp, Homo sapiens
tttcattgtctttttaaagtttgcatctcaaagtataagtcgcagaactgaacaggaaattccagcatgttcatcatggagaagtttgaagatgttctgctgctggctttgaagatggaggaagatggaggaaggggccacaaaccaagcaagcctcctctagaaattggaaacggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccctggactctgggcgtaatttggaagggatgaaagtaggtttgtcacacaatctttgatgaccatgtaaagccatacattggtatttccttgctgtttaaaccccatctgaatattataaagacttgaaaacattttacctagaattcatttttccaattgaaaccccactgttctaaatgtgtatgcacacattaataaacgtatttaagttgtgcacgaatctggctacgtcatatagagtaggaaagggaacttgtcagggtctgggttttcatgtagacc

SEQ ID NO: 464832 - DNA, 792 bp, Homo sapiens
caggaaacgtttactgaaccagctttaaaaccgtgctaattcataattaaatgttgtgaccaatataggtatctgctgtacaaaattttatatagatgctcatcaacttaagatgggcttacatgctgataaacccatcataagttgaaaatattgtatgtctgttgaaaatgcgtgtaagacacctaacttactgaacattatagcctagcctagtctaacttaagcttgctcggaacacttaacgttaacctacagttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaaggtaagcagagtccactgtcctggggcttaataaggtaatgggaatagaaatgtaagactctctcccttccctcttttcttgccaaaggaattaaaggagttccctttcctgagagctttttagaatgttgaagttaaccctcccaacttttttctctcataatgggaaagcataagcagtgaaatgggagttaaagttcttttctcttgccaaccttctcccctttaacttttattagggaagaaagctggcaacatacaaatagactccatgtgtaaatagagacaaattgactgtagatagaa

SEQ ID NO: 464833 - DNA, 1817 bp, Homo sapiens
tttcattgtctttttaaagtttgcatctcaaagtataagtcgcagaactgaacaggaaattccagcatgttcatcatggagaagtttgaagatgttctgctgctggctttgaagatggaggaagatggaggaaggggccacaaaccaagcaagcctcctctagaaattggaaacggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccctggactctgggcgtaatttggaagggatgaaagtaggtttgtcacacaatctttgatgaccatgtaaagccatacattggtatttccttgctgtttaaaccccatctgaatattataaagacttgaaaacattttacctagaattcatttttccaattgaaaccccactgttctaaatgtgtatgcacacattaataaacgtatttaagttgtgcacgaatctggctacgtcatatagagtaggaaagggaacttgtcagggtctgggttttcatgtagacc

SEQ ID NO: 464834 - DNA, 1261 bp, Homo sapiens
tttcattgtctttttaaagtttgcatctcaaagtataagtcgcagaactgaacaggaaattccagcatgttcatcatggagaagtttgaagatgttctgctgctggctttgaagatggaggaagatggaggaaggggccacaaaccaagcaagcctcctctagaaattggaaacggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaaggtaagcagagtccactgtcctggggcttaataaggtaatgggaatagaaatgtaagactctctcccttccctcttttcttgccaaaggaattaaaggagttccctttcctgagagctttttagaatgttgaagttaaccctcccaacttttttctctcataatgggaaagcataagcagtgaaatgggagttaaagttcttttctcttgccaaccttctcccctttaacttttattagggaagaaagctggcaacatacaaatagactccatgtgtaaatagagacaaattgactgtagatagaaccaaaaaacaaacaggatgacacagagcgagactaggtatttgccacaggatcctgcaagtcccgacaatg

SEQ ID NO: 464835 - DNA, 1664 bp, Homo sapiens
cctgttatttgcaggaccctgtcacccttggctaggccaggtatgttctgcaccgaaaatggccctgccctctgcattggatggctagctcttaggttggtttattttagcaaataagcgttacagggtaggcgaactggctgcatcagaaccacaattacccctgtgtctctgggtgggataaatggcggatggcattctggcagctcagccccacttatctcagaggttatagatctgaggtggtttagatccacccccaaatcacgaacattttacataagccgtgctagagttagcataaaagtctcacagaaaaatttggaaactgagaaatcctaacctattcccacaatcctgtgttcccatttttaggtcttaagatatgaagacaatgggataactgaggctgattttgctgtgtggccattagacctagaaatattggtgtgattctggagttgattgctccacacgtttatttatttattttcctttttttccctcctcttcctcctcctctattctttaaaaacgtatggaaatgtatccggcaatgtttactgtaaaaaataatgtatggaaatgactacaatttgctaaaataaaaatcattgagcacttatgtgtgtcagacactatgctaggtataaagaggggaagatggtgtccctattcaaaagagagtcacacacacttaagttacagtgcagtcataaataccatgatcgcagtatgcacaggtccattttctctatctgggtgatgggaaggttcaaaactaagctaggttttgaatgaggaatagtttcattttgaagcacatccattttgcgatgcctctggagctatctagtgaacaatttagatgcgtggttcagaagctcgatgggaggcttgggaacacagaatgtgtaaaataagcatcagtctccctttcaccctctctgcactttttaagggtcatctgtctttagtatatattggtagaggcagctctaatggcttccatttggccttcccgcttaatagccctcaccctaccagtgaggcagccaatgtgggagttctgccagctcctaagtatatctatgccaatgatgcattctggcactggggaaatgaccacaggatgagtccaggggcccactggacccactacaaaggtggaaaggctgatggcagcatgggtcgaggagaggatgctgctactactggggatggggaagctgttccttctggcaaaaaacgttcatcagagtttacaaactcagtgtccccgacttcatcagggtcctcccacaaatccacattccaagtttcagggtcccagtcttttcccatgaatgccctcactttaacagtagacacctggcaaagctgtacatgtatctttcattggggagaagattgctagcttgtcgtgctccttggagacattttgtagcataagctcttatatttaggtctatgatgcatatcaaattaattttcacatatggtgtgaggtcctaaactgcaaccatctctaaccatctgattaggtttccatgaaccaagcctcagatcgtccatgaatcatgaccattgagtcaacatagcacagggatttcaactttttgtaaagaaaatgttcacgaggtgaatctttacatgttcatttt

SEQ ID NO: 464836 - DNA, 1465 bp, Homo sapiens
ggtaggcccagagcgaggacgggcccggactgggtagtggggatgtaccagggccgggtgcggcgggagacggcccgggaggcggaaggtcgcggacctgcccgacagaagagtagatgaggggagaccgaggacgcccgggtccggggagcttacgaggaggccaggatcgcggggtcttaagatatgaagacaatgggataactgaggctgattttgctgtgtggccattagacctagaaatattggtgtgattctggagttgattgctccacacgtttatttatttattttcctttttttccctcctcttcctcctcctctattctttaaaaacgtatggaaatgtatccggcaatgtttactgtaaaaaataatgtatggaaatgactacaatttgctaaaataaaaatcattgagcacttatgtgtgtcagacactatgctaggtataaagaggggaagatggtgtccctattcaaaagagagtcacacacacttaagttacagtgcagtcataaataccatgatcgcagtatgcacaggtccattttctctatctgggtgatgggaaggttcaaaactaagctaggttttgaatgaggaatagtttcattttgaagcacatccattttgcgatgcctctggagctatctagtgaacaatttagatgcgtggttcagaagctcgatgggaggcttgggaacacagaatgtgtaaaataagcatcagtctccctttcaccctctctgcactttttaagggtcatctgtctttagtatatattggtagaggcagctctaatggcttccatttggccttcccgcttaatagccctcaccctaccagtgaggcagccaatgtgggagttctgccagctcctaagtatatctatgccaatgatgcattctggcactggggaaatgaccacaggatgagtccaggggcccactggacccactacaaaggtggaaaggctgatggcagcatgggtcgaggagaggatgctgctactactggggatggggaagctgttccttctggcaaaaaacgttcatcagagtttacaaactcagtgtccccgacttcatcagggtcctcccacaaatccacattccaagtttcagggtcccagtcttttcccatgaatgccctcactttaacagtagacacctggcaaagctgtacatgtatctttcattggggagaagattgctagcttgtcgtgctccttggagacattttgtagcataagctcttatatttaggtctatgatgcatatcaaattaattttcacatatggtgtgaggtcctaaactgcaaccatctctaaccatctgattaggtttccatgaaccaagcctcagatcgtccatgaatcatgaccattgagtcaacatagcacagggatttcaactttttgtaaagaaaatgttcacgaggtgaatctttacatgttcatttt

SEQ ID NO: 464837 - DNA, 2760 bp, Homo sapiens
gcaaaaagcgctcgtgcccacctcaagcccatgttcggtgggtggcgaatgcgtgcccgtgatctgctgggtctgtagaggagcgcaggcctggtgcaaacagactcaagaggctcggagaaccagcttggagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaagaaaagtatttggtgatatgatcttaatgtggtgttagtgttctgtgtgccatattaatattaggttctcttcagagtcttctgcattgactgtcataattactgcctttgatatgtttgtagagacttcatgctacccataacttgatggaattgttgatagccaggca

SEQ ID NO: 464838 - DNA, 1346 bp, Homo sapiens
gcgcggggcgcggcggcggcaccaggcggttcgactggagccctgcgtcagccggcggcacgcgcacacctgcccgccgccgctaccggccgcgtcattggctgccggcgccgagcgcgcgagattgaaccttccattcattccagggccgggcgggcgagcgcggccgcggtggagctttaccgcgggcgcccccgaacccccgaagcgcgtccccgcgcaggccgtgggcgcgcacggccgctgccgccgtttgttctggtggaggctgcgagtgcctgggcctgtgactcccggctctccgcgcgcagcatgccctggacatcattccgaacagcacaattcaagggtggctgaaacaacaaaaatgtaacgtcttacagatctgaaggcttccgggtcgattctggactgtgatgagaatctgtgccaagcctctctcctggcttctggtagactcgggcattccttagcttgtaaatggctgctgcttgtgtcatcacattgtcttccctttctacttatctgtccccatgccccaatttttccttttcaggacaccagtcagattaggacccaccctaatgatctcatcttaacttgattaactacaaggaccctatttttaagtacacatttacagagactggggggtaggacttcaacatctttttggagggatgcagttcaacccataacaagaatcattgttagaaatgattttgcttcttcactgaaaaattaatatcattctgcagagaactgacttgctgcacatggcacagattttttgcatttatcataggctgcatttcacacaactaatgaaaaacaaggttaaaaagaacaaagctggtggcatcacattacccaacttcaaactatactataaggctaaagtaaccaaaacagcatggtacaagtacaaaaaacagacacatagaccaatgaaacagaatggagaacccagaagtaaagctgcacacctacagccatcactacaaaactttgatgtacaaattaaagtatacaatacattattagtaactatagtcaccatgccatatgttagaccaccagaacttattcattttataactgaaagtttataccctttgaccaatatcacttcatttccctgcccccagcccatggcaattactattctgctctgtgcttctatgaattcatttttttaagattccacatgtatttgaagttacttgggtgttgtgatctaagtttttggtcactgcagtcatatctgcattatagggcaccccaatctcagtaaagctatggctcttgcacacttgtagaggtactgccttgctgttctttgatac

SEQ ID NO: 464839 - DNA, 1960 bp, Homo sapiens
  misc_feature (550)..(551): n is a, c, g, or t
  misc_feature (556)..(556): n is a, c, g, or t
  misc_feature (560)..(560): n is a, c, g, or t
  misc_feature (562)..(563): n is a, c, g, or t
ctgctccaggcctctctccgggaggcgaggcggctccgggcaccttgtctccagctgaggctgagcgagcacgcctttgtttagggccccttgtctcggcctgtgtcagagcttgcaggggcgttgggcctctctctgcagggaggactggttttagaggactcccgcttcccccagttgtatcagttcaggtgtaaacccgatatgcaataggatccggcgtggtgtccacactcattagacacatggcatcgtttccaaagatacaggcccccgcacttcagcttgatgccagagggcttacacgtaaactctgcttgacttggaaatcaaagagaggtgagaagagttcagattttctcctgctgaggtaggaggctcgccaagagacaagactggactcataaggtctgcaactggctttatctagttaatagcagcctttgacatcacaaaacatgctatttccttgtgttcatgtctttaagaggagccacggtgaaagcaaacattaaagattttaatctaacaaaaatgtggagtgaaattnnttttnctgnanngattttagcagagaaaaatctggtgcacctaatattagattacagcaaagagagtgagaatggtgtttgttcagaaaagccctcagcatcattgcgaaccattcaggcagcacgggagcttctggaggtgaaggtgtctggtgaggctgatcagacatgggctgagtctccaagttctcatgcacacatgtgcttcctgcgcttggacttctctcctccaggctcagccaatctcaggggaaacagcactccggcaggagtgactccttctcccacagactccttgcagcacacacagacgtttccagtgattcccaagaaaggttaaatttacaagaacatagtcaccactttctattttttatacattttataaaattgagtgtgattttggaacacagacagacattcaaaagatcatactactagaaacattatcatcctgccacccatttagctcagaatctttgagttaggtgagttattttacataaaccataaaattttatcaattgaatttaacaattgtaaaggtaatcccatactatactcaccaatagctaatggctattttaaaaattgtgggatctaatttttccctctattcattttacttgtaataatgtaatctcagtatagcacactggggctaattaattaggacagttcaagttggaatatagttacctgttaatgaaaatgcttgatttcagaaatgatcacctattcaatgacatatgagaattataacacataatttatatttataatataacaattacttgatttcatcatttaaagatattttataaaagtgattcctaatagaaaacaataatttaattttaaaaacataaatcaagaaagtaaacattgtaaagtcaacagcaacttaattaatgtcagtgttttcaatacaatgtattattaagggaactgagcatattaaaataatacatagtatacataagaggacataattttaaaaattgacaatttatgacataatatttactcaaaaactcaattgaatgcctatatgtatattaaaatatatgtaggtccctaattttcaaaaataacttaaatgctgtttataaaatttgtagtccattatctattatctaaacaaatgcaaagagcaagaaactttttttgtacaagcaaatatcaagttacagcacagttaataatttccatttattgtatataacttgaatattgtacctctataaaaattagtcataactttctattcagaatttttatttaaaaagtagagattttattacaaatcatttaacttatgttaattcctcttttgtgttaaattttaaaactgaataagaagttaaataaaaactcaaagaatttctatttgtgtcattccatcagat

SEQ ID NO: 464840 - DNA, 3922 bp, Homo sapiens
ttgcagtgagctgagatcccgccaatgcactccagcctgaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggagaggatcaagctcgctatgctggtgacataattaaagctcttgaattgtcagggactgcagtacctcctgatttagagaaactgtggagtgatttcaaagatcagcagaaagctggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacaggcaagtaacaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaagtgtttatttatatatctatacatgttgtatgtacaaatatcctactacttttaatctgatttttcttcaggattattgagtaggttgtgaattttctttcttaaaaattgtaaaacataatggtacccaagttttaaacttagatgtgcttcatcttagtgaaatttaattcacaaggaatcataaattgtgtttttgaggctgggcgcagtgactcacacctgtatcccagcaatttgggaggccgaggtgggcagatcacttgaggtcaggagttcaagactagcctggtcaacatggtgaaaccctgtctctactaaaaatacaaaaattagtcggcatggtggtgggtggctgtaatcccagctactcaggaggctgaggcagaagaatctgagccaagataacaccattgcactccagcctgggcgacagagtgagactatctcaaaaataaataaataaataaataaatagtatttttgagccttcaagatacagttcctgaatattctaatttaaattgttataattggattacctaatattcttttcaagactcctgatgtattaacttcatgttattgtcacttttcaaaaaaggaatttttttcaggagttaaataaagtcagtcttttatatccaagggtttcaaacccacagattaaaccaaccacagatcaaaaatagaaaaaaaaaaaaaaagaaaaaaagaatgt

SEQ ID NO: 464841 - DNA, 3588 bp, Homo sapiens
  misc_feature (1)..(1): n is a, c, g, or t
  misc_feature (3)..(4): n is a, c, g, or t
  misc_feature (9)..(10): n is a, c, g, or t
  misc_feature (14)..(15): n is a, c, g, or t
  misc_feature (17)..(18): n is a, c, g, or t
ntnnaggcnngganncnngtgagggggtggcctgaaatggctggggagtaaactgaaactgcagctggagggacagaaaccggaggagtgggatcagggacaaccagaagagtgacgcaagcaggggagggacctgaaacggaaatgggagccggagggaggggttggcttctggctttctcctcctggagtctaaagggtgaagaaggacaggtccctgctgccaacagagggcataatcgatttcttccttggagacagggctcttatcattaacacgctcgattaagagctgacaaatctgctcctcattagacctaaattttggccagaaaactgaatacacagtgtatcacagtgttgcttctaaaaccggggaatcagggagttgaccaggaacaaagcagggccatcatgactgaaggaagaaaaacaaatggaaagctaaactatgtaagcatccagggagtctgtgagattaagcagaagaaaaatatatttactattcatgaagtggaagtggatcatcataaaggtcttcatcctcaccatcttcatgtggttgaggaggaggagaaagagaagggctcagactctccttgggtggggcttgctgtggctgctgtggtggatgggggtgtggttcttaggccaatggagttatgttcccagggagattatgactacctctgctgcgtcatgcagaacctcatttctaagaagcgtcttgtggaaccagtgttatgtgaaatatattttggaaaatttggcctgggcaaggggaagccagtgaatgttttaaggagggtgacatggtccaaaatattttatagggccttctcttggcaggaatatgatttgatgagaaagaggctagaggcccagagaacagatgagagctcattggcatcagcacttggacatttaagggaactctgtatcaaagctgagatgtggctggagctttaagataggtgacattccttacttaaggggaatatttatatccactaattttcaattttgagggatctcataaagggtagaaaaccatgatggcaacaacatccctccaaaaaaaaaaaaaccacccttgaatcgtgtttatatatatgtatgtatgtatatgcatatgtgcatgcctgtttgtgtgtttattaactccagaaaatggctacttgtggctgagcagaatgataagagaggtgatacatttgagatgtaaacttgtcagagggctgaaaattctatgtgaccattaccaaagcacacaagtgggatgagggatgctgtaatttctcatctggattctttagctcttataaaagcattttttttgcatgaatagttgttttaaattgatgtttccaagagaggataggagctgaaaacttctgttccatcgttgccttagtatattttgagctgttataacagaatgccacagactggatgatttataatgaacagaattttttttgtcccacagttctggaggtcagtaagtccaatatcaaggtgccagcatcaggcattatggccagcacacttcctgcgaatttgtaccaccaccccttatctcatctatgcttctgctcacagcactgcactggagccaggggatggatacctggcacttgtatgtcctatgaagaaagagaggaggatacattgcttccctatgtatccttaagggatagaccagaggaaaagttaagtaatagataaacaatcaataatacctaattggtttcccaatcaattagcacttactgtgttggatttgttcactttcagccatagttacaccttgaatttctgtatttccaaagtgggctcttttttttctaaggaatttcctcaattttttcgtgtaagtaggcttctgaggagtctatttcactgatttttgtgatatatttaatcattccagggctacaaaatttaagctgaatttaaattattcataatataacaatctctcttcctctgtctctctttctttctatatctttcattacatatatgtaataaaatattttcattatatatctgtatatcttttatagaaatcttttcattatatatttcatatatattcatgtatctttcatacattatatatattcacatatatatctttcatatatattcatatatgtttcatatattatgcatattcatatatatctttcatatttctatatttttttttattacatttctagtctcactcctcaagtcctcaaggtcagatactaattcctagagcatggtgatgaaattccaggctagatagacctaagttcaaatcatagttcagctgcttactaattatgtgggccttgacaagttacttatcttttttaagttgactaatatttaaagtaaagataagaacttttttaagttgactaatatttaaagtaaaaataagaacacgacctgacttgtagggtggtagtggaactgagtaagctaatgcatataaaatcattaagaatagaatccagcatataatgtgtgcttcataaatgttagttactgtgattgttgttatttttgcctggattatagcagaattgtcttaacaggtctcctaatgtttatttggagctcttctagttcattctccacactgctgtcagagtaatctttccaaaaattaactgtgattgtgccattcctctgcttaaaaccaattgattttcatagtttttatcgtaatatttagatgccttagcctggcatgcaggcccgttgtaatctcctgctgtctctttagttttgtctcctaccggtcttccccaaattttcattgctcttaacataaacaaatacttaaatttttctgaaagcagcatgctcttttgtttctcctggatgttgtgtatattaactcctattcatagaacacctttgtcctcattttcctctgtttaatttctactcatttttcaaaaccctgtaaaagtatcacagcccctaagaaatcctctaattccctgaatttgactgaggggacctcattctctgctttgctaggcacttgtccacagtctgtcttaacacttttcatatggtgcaattatctctttcctatccgtggacccttttatattgaaagttctccaaggacaaacagcatgtgttatcttatgtcttcaatgcttataagctgccttggaaacaataggtacatgtttgctgaataaatgtctggtagaagaagtcatatcaataagcataattttttaaaagaaagttgtaggcttcttggactcaagtctgctatttagaggaaccatagccaagaatatcctagaagcatggaaagtttattaaattattattagcttttgttattgtacaaaaatcagcatggatcaaattataatacttcagcatagatttcaggatttttttttctttacaaagcctagaaaataagcaattctaaataagtaagtaataaatatttccaataggttagcttacatttgaatcttgtataaaattgaattgttccaatcccttttatttaacatatagcaactcctcagagacctaaggacagaaataccattc

SEQ ID NO: 464842 - DNA, 2059 bp, Homo sapiens
ataccggggggccagtgccatgctgctgagggatgtcccaggctattgcctctacttcatcccctacgtgttcctgagtgagtggatcacacctgaggcctgcacaggccccagcccctgtgccgtgtggctggcgggcggcatggcaggtgcctgtgctcatgcccagctcctagtaagagctcagtcagtaccgactggcagagaggacggcaaggccccatttgctctcacttttgcagagagcagagtaaatcctgccctcagtgagctgcaaaccttcagcctcatgcctcaccctgggctctcttctggtgccctgggaaggtgctcccaagtacctgtggagcctgttactctttctccaataaaaactgctaataaatactgccacgtctcgagcactggctgtggactggcacttgctcaatgcttcacgttcatcaattcatttggtcctcaaaacagccccataaagataggagcaatttcttgggggacagcgactcctatggatgtcgtgaaaagtcgactccaagctgatggggtttatttaaacaaatataaaggtgtcctggactgtatctcccagagttaccagaaggaaggtcttaaagtgtttttcagaggcatcactgtgaacgcggtgcggggcttccccatgagtgcggccatgttccttgggtacgagctgtcgctgcaggctatccgcggggaccacgcagtgacgagcccataagcgccagggtctcatcccattaacaggtcaatgctaaaagtgtctgcagaacccatgatgtgaatttactgaagagaaagactctccaccaggtgggctttcagccaggcaggctgtcctcagaacctcttccttccttcacaattacaagcattctcatccccaccccggctggggcagcggagcttctgccttggagggattcaactgaccattggtcaactgatcaccaactattccagctttggacctgcacctggtaacaaacaaacgaacagaacaaaacaaaactggagtaaaatagaccctccccccatggccattgtaaactcactgtgaattcatggaagagctggagttggctctaagtttcaaaataaaagcattaaaaacctcttcacattgtttctctgtcagatgcctctgcctagcttccaagaggcacctggccactgtcattcctctctctctgttcaggcctctgtgggtgttgcaggcccagagggaaaacccctccacacaggtgtctgagcttttcctagtttctattaatcatcatggcacctcttgatggtagaaggaggcatgcagagagaagcattgctgatccagttcacagatgaaggaactgaggctccaacatacctgagccccagctcaggactttaccaccaatcccatttgataatcttcctgaggctacacttccctgctgtccagcccaggcagcatccatggtccttccaccaacgtgacccctctggcactgtgtccctccctgtgctacagtcatgtctgtgcaccctctctttctcactggcctgtgccccccttcagagccagggctgagtcttcccaatccttagattcagcatagcagcaagaatgaacagggtttagaataaaggaagcataaattaatgggcaaaaatgcaagcatgaccatgttaattgagaattgtttgtaataatgaaaattcagaaagtttctaaatgcctatcaatagaagagggggttgaacaaacagccactaaaaagaatgagatagatctcacatatattgtcatggaaatatgtcagcaacattgtaagtgcagaaatggaggggcagaataacatatatgatgttattcattttcattttaaaatatatatcgtatatggggtggcttctgtataagcatcttcagtcccatttggtccctgtcccgtggtccgagcctgacatatgtgcccatcccaaggcctctccagccttaccatcctccaagacacatcagtgcccctctctgccctgtgtgaaaatctttggtttctcc

SEQ ID NO: 464843 - DNA, 1481 bp, Homo sapiens
cagtttttccgtcggtttgtcagccccatctatttcgagtgtttttcagaggcatcactgtgaacgcggtgcggggcttccccatgagtgcggccatgttccttgggtacgagctgtcgctgcaggctatccgcggggaccacgcagtgacgagcccataagcgccagggtctcatcccattaacaggtcaatgctaaaagtgtctgcagaacccatgatgtgaatttactgaagagaaagactctccaccaggtgggctttcagccaggcaggctgtcctcagaacctcttccttccttcacaattacaagcattctcatccccaccccggctggggcagcggagcttctgccttggagggattcaactgaccattggtcaactgatcaccaactattccagctttggacctgcacctggtaacaaacaaacgaacagaacaaaacaaaactggagtaaaatagaccctccccccatggccattgtaaactcactgtgaattcatggaagagctggagttggctctaagtttcaaaataaaagcattaaaaacctcttcacattgtttctctgtcagatgcctctgcctagcttccaagaggcacctggccactgtcattcctctctctctgttcaggcctctgtgggtgttgcaggcccagagggaaaacccctccacacaggtgtctgagcttttcctagtttctattaatcatcatggcacctcttgatggtagaaggaggcatgcagagagaagcattgctgatccagttcacagatgaaggaactgaggctccaacatacctgagccccagctcaggactttaccaccaatcccatttgataatcttcctgaggctacacttccctgctgtccagcccaggcagcatccatggtccttccaccaacgtgacccctctggcactgtgtccctccctgtgctacagtcatgtctgtgcaccctctctttctcactggcctgtgccccccttcagagccagggctgagtcttcccaatccttagattcagcatagcagcaagaatgaacagggtttagaataaaggaagcataaattaatgggcaaaaatgcaagcatgaccatgttaattgagaattgtttgtaataatgaaaattcagaaagtttctaaatgcctatcaatagaagagggggttgaacaaacagccactaaaaagaatgagatagatctcacatatattgtcatggaaatatgtcagcaacattgtaagtgcagaaatggaggggcagaataacatatatgatgttattcattttcattttaaaatatatatcgtatatggggtggcttctgtataagcatcttcagtcccatttggtccctgtcccgtggtccgagcctgacatatgtgcccatcccaaggcctctccagccttaccatcctccaagacacatcagtgcccctctctgccctgtgtgaaaatctttggtttctcc

SEQ ID NO: 464844 - DNA, 1979 bp, Homo sapiens
aggcggcagtgtccgctgcaacggttggggctgcgcgtgagaaggtggcggtgtaggcacctgcgctcggggaaggctggcggcggcggccgggccatggccagagaccccctcctctgggctccctgaagtcctggggagccgtgacccatgggatcgtcgagcagccgggtgctgggccagccgaggcgagcccttgcccagcaggaacagggtgccagggccagggctcggcccggaggccggacactggagacgatgcggcgagctacggcttctgttactgcccgggcagtcacaagcgcaagcggagcagcggggcctgccgctactgtgacccggactcgcacagggaggagcatgaggaggagggggacaagcagcagccgctcctcaacacccctgcaaggaaaaaattaaggagtacatccaaatatatttatcaaaagcatttacttcttttggaaacttggggttggaacaaagagccaagggttgggaaccacttttcacggaatttttgctgggctttctaggagaagaatggcgattacacaaaatatatttatgtcaatctggctacttttctagtatgttcagtggttcttggaaagaatccagcatgaatattattgaactggagattcctgaccagaacattgatgtagacgcactgcaggttgcgtttggttcactgtatcgagatgatgtcttgataaaacccagtcgagttgttgccattttggcagcagcttgtatgctgcagctggatggtttaatacagcagtgtggtgagacaatgaaggaaacaattaatgtgaaaactgtatgcggttattacacatcagtagagatctatggattagattctgtaaagaaaaagtgccttgaatggcttctaaacaatttgatgactcaccagaatgttaaactttttaaagaactcggtataaatgtcatgaaacagctcattggttcctctaacttatttgtgatgcaagtggagatggatgtatacaccactctaaaaaagtggatgttccttcaacttgtgccttcttggaatggatctttaaaacagcttttgacagaaacagatgtctggttttctaaacagagaaaagattttgaaggtatggcctttcttgaaactgaaccaggaaaaccatttgtgtcagtattcagacatttaaggttacaatatattatcagtgacctagcttctgcaagaattattgaacaagatggtatagtaccttcagaatggctgtcttctgtgtataaacagcagtggtttgctatgctgcgggcagaacaagaccatgaggtagggcctcaagaaatcaataaagaagacctagagggaagtagcatgaggtgtggtagaaagcttgccaaagatggtgaatactactggtgttggacgggttttaacttcggctttgacctacttgtaatttacaccaatggatacatcattttcaaacgcaatacactgaatcagccatgcagcgggtctgtcagtttacggcctcgaaggagcatagcatttagattacgcttggcttcttttgatagtagtggaaaactagtatgtagtagaacaactggctatcaaatacttatacttaaaaaggatcaggaacaagtggtgatgaacttggacagcaggtttctgaccttccctttatatatctgctgtgagctcatccagtttcctggcatgaaatcccacctttatgaaaatgattcaaatctctttctctaatctggtcttttcccctgagctccacaaatagtcttcctctccacttcctgatacattgttcttaaaacctgaggaatctccagagagaaatacaaatatagccttctacctccccgtcaccagactcctcccagggaaagtgtatctaactatgggctccaagacagaacaaaccaagggttaacagttgatttgcaaactgaagcatgcc

SEQ ID NO: 464845 - DNA, 1938 bp, Homo sapiens
aggcggcagtgtccgctgcaacggttggggctgcgcgtgagaaggtggcggtgtaggcacctgcgctcggggaaggctggcggcggcggccgggccatggccagagaccccctcctctgggctccctgaagtcctggggagccgtgacccatgggatcgtcgagcagccgggtgctgggccagccgaggcgagcccttgcccagcaggaacagggtgccagggccagggctcggcccggaggccggacactggagacgatgcggcgagctacggcttctgttactgcccgggcagtcacaagcgcaagcggagcagcggggcctgccgctactgtgacccggactcgcacagggaggagcatgaggaggagggggacaagcagcagccgctcctcaacacccctgcaaggaaaaaattaaggagtacatccaaatatatttatcaaacattatttttgaatggtgaaaacagtgacattaagatttgtgctctaggagaagaatggcgattacacaaaatatatttatgtcaatctggctacttttctagtatgttcagtggttcttggaaagaatccagcatgaatattattgaactggagattcctgaccagaacattgatgtagacgcactgcaggttgcgtttggttcactgtatcgagatgatgtcttgataaaacccagtcgagttgttgccattttggcagcagcttgtatgctgcagctggatggtttaatacagcagtgtggtgagacaatgaaggaaacaattaatgtgaaaactgtatgcggttattacacatcagtagagatctatggattagattctgtaaagaaaaagtgccttgaatggcttctaaacaatttgatgactcaccagaatgttaaactttttaaagaactcggtataaatgtcatgaaacagctcattggttcctctaacttatttgtgatgcaagtggagatggatgtatacaccactctaaaaaagtggatgttccttcaacttgtgccttcttggaatggatctttaaaacagcttttgacagaaacagatgtctggttttctaaacagagaaaagattttgaaggtatggcctttcttgaaactgaaccaggaaaaccatttgtgtcagtattcagacatttaaggttacaatatattatcagtgacctagcttctgcaagaattattgaacaagatggtatagtaccttcagaatggctgtcttctgtgtataaacagcagtggtttgctatgctgcgggcagaacaagaccatgaggtagggcctcaagaaatcaataaagaagacctagagggaagtagcatgaggtgtggtagaaagcttgccaaagatggtgaatactactggtgttggacgggttttaacttcggctttgacctacttgtaatttacaccaatggatacatcattttcaaacgcaatacactgaatcagccatgcagcgggtctgtcagtttacggcctcgaaggagcatagcatttagattacgcttggcttcttttgatagtagtggaaaactagtatgtagtagaacaactggctatcaaatacttatacttaaaaaggatcaggaacaagtggtgatgaacttggacagcaggtttctgaccttccctttatatatctgctgtgagctcatccagtttcctggcatgaaatcccacctttatgaaaatgattcaaatctctttctctaatctggtcttttcccctgagctccacaaatagtcttcctctccacttcctgatacattgttcttaaaacctgaggaatctccagagagaaatacaaatatagccttctacctccccgtcaccagactcctcccagggaaagtgtatctaactatgggctccaagacagaacaaaccaagggttaacagttgatttgcaaactgaagcatgcc

SEQ ID NO: 464846 - DNA, 1136 bp, Homo sapiens
gtggatgggctcctctttagtgggagatttctgttagctctggttggagcagagagacttcttccatggagaagcccctcaccgtcctgcgagtgagcctgtaccatcccacgctgggcccatctgcctttgccaatgtcccaccacggctgcagcatgataccagccctctgcttctcggacgggggcaggacgcccacctccagctgcagctccctcgcctctcccgccgtcacctgtccctggagccctacctggagaaaggcagtgccctgctggccttctgcctcaaggccctgagccgcaagggctgtgtgtgggtcaatgggctgacgctgaggtacctggagcaggtccccctgagcaccgtcaacagggtctccttctcaggcatccagatgctggttcgcgtagaagaaggcacatccctggaggcttttgtctgctatttccatgtcagcccttcacccctgatttacagacctgaggctgaggaaactgacgaatgggaaggcatctcccaggggcagcctccccctggttcagggtagcagatccaggttgcctggggtttctccacggcccttcccagacttgggacagccctctccagccaagacctggaggaggaacagaaatacagctccagagggaacccccagacagtgcactctgctagccctgccactagagcaagcctttgctagatgaaacaggatttgaaatacttgagctgcatcatgcaaggttgacaagcaaaacccactggctgccttgctcataatgaaccaattctgcaaacaccgaacaaacagcccaggggggagaagcaccctctgtggccagagctatgcaatgtaatgggaacatcatatacttttagaggccctgaggggttctggggagcctctctcagcatttccacacatttctccctgttgtctgactaggagttactttatgtggttcattttgtgtgctgcttaagagcaggagtttgaggttgcaccaggaatgcgtggacacatgtaacaattacatttgtggtagcttggggttaccttcagctttcaaatacccacaggcacgcggggcttaggaaagcctgagtgtaataaactgcaagtatttcatta

SEQ ID NO: 464847 - DNA, 1083 bp, Homo sapiens
ctgcggtgggaacaatcctgagatgactcagggagtggagagaaggctagtggaagagggctatgaagaagaggaggggtggcagattcacccatgggagctgaacacccaaagcaagaaaatcaggggctctgggaaaggaagtgagtcaagacaagcaagagagaaggatgagagcgagcacctccaggatctggtttaccagagaagacaagctgcgaggaggccactaaacttctgccctggcacagtttgctgcagggaggcagccccagaactagtggagacggcgtcccgcgtccagcgcccggagagcgggggcggggccctgggggcgggctctgcggcctgtggctgcagagggacgcaagagcataaactgaaatcccacatccccgtggaggaacttggagataagatgcaaagcgcagcaaataggagccactctttcagagatgacagaccacctggtttcgaggagcagcagacagcgtgaatgaatgaagttggccaggtaaagaactgaaatgcagacaggaaatgggacttgcctgacatggagcaggtggtaggtggcagaggaagattggccactccataacctgtgctctctccaattctctggactaactgtccatacagatgattgccctgggactgagcttagggatttccaaactcttgctatttaacaactgtcaaagactgagaaacagggcttatattttattcaagctacccagaatagggcctctctctaatctatacttccttttcggggaagagatatttggcttcaggcagcagtagcgcctgctccctagggaagtggttagaggtacccacttccccatatcagcagaaacaaaacaggcaggagtctctctgcttgaggatctgcctaaatagggaagtgagaattggcaaccacttctccctccaccaatgggaatcctagatggagggaactgggtgggagatggcaggggtgggcagagtggcagcatttctgtttcttaaatccataactccatcttcagacacttgattccacagccatagggaattgtatatattttgctg

SEQ ID NO: 464848 - DNA, 738 bp, Homo sapiens
ttctatttctggttgccagagccttcagttgacacagtactaagatgagactgaagcaaggatcgtttctgtggtacctctatctggacaaaatatactgcttattatccgtgagaaacgtgaaggctttggcagaatattttcatattctggacgtgcacggcaagaacaccttgaatgatgtgctgttctatcacttccttcatcatgtgactgacttgaaaaaggcacagatcaacattgtgtttgacatgctggactggaacgctgtgggcgagatcgactttgagaagttctacatgctgaaccatttggaaggacagtttatgtatcgtcattcccggcctgtctttgacctgcttgacctgaaaggggatctgagaattggtgcaaaaaacttcgaaatgtacagatttctcttcaatattcaaaaacaggaactcaaagatctcttccgtgactttgacattacaggtgacaatcgtcttaattatcaggaatttaagctgtatacaatcatctacactgacaaattacagaagaggcagaaaacagaggagaaagaaaaaggagagagaaagagaagtctctactcaaaatgtcacatcaagtagatacaagctgaaagagtcttggaaaaaaatgggatctgaaagtacagaacatgaacattgatgaagactgttaacatgtctaaaaataaattcagagcatcaaagtagatatctttataatgac

SEQ ID NO: 464849 - DNA, 1396 bp, Homo sapiens
  misc_feature (1395)..(1395): n is a, c, g, or t
acctagccctcgatgccccctcacttctccccctcccgggcgccccgttcggttgaagtttacgtatcttgggacctaattgctcccaattatccgcgcagcctaagtcccgcgtctgcctggctctcgccccgggagcctgaagctaccgggcagttcattgggtgtcctcggggaaaaggttcaagctgtagagatgagagaagtggggctgggggaggggagaggctccagaaggaagaccacgaacacgtgcgaagaaataaaagccaccacgtgtgcacgcgcgcgggggcccaagggcgcgagcgcggagcacgccccagggggccagggacagtggtcccctgcagcgggcatagcagggggcgcgggtactcacacgaaagcgtggtagatgaacgcccagccgcggggtctctccagcacgttgtacagaaattaatcagagaacccaggacaacgtcagagatcatatgagcctcaccagactgcatgagagtcataacacagtaggagtcccaggcctacctcacatggcaaatgggacagtgttcttcagaacaacctctgccccagggatgcagaaaggagggtttcactatgttggccagtctggtgttgaactcctcacctcaaatgatctgcccaccttggcctcccaaagcgttggagttacagacgtgagccaccgcgcccagctggagaagatgtgaaattttgagagctgaccatactttgagaataataagtagttggattctactgaagcccagtggcttttggaggtgtagcaataagcaggaggcagcagaagtaagacaagggctgtatgacaaagtcttggcaagaactttgaattttatcctgatgtgagtggggagagccactgaagaacgtgaagccagaaacactacatgttactacttctactttcagaaaaggcttaatatggattatacacctacaagtggcacacactgttccaagtggagactcaaagatgataacgatacagtgtttatgctataggtttgtgaagctaccaatccatggacagatgttaaacctaacttccaatttcaggtacaaatatctgagtaaatgatggtatcatttactcaatcagtaaaggtcaaagagaaggcagtctgaagaagggaaaggtgttcaattttgcattgagtttgacatacctgttgagacagctcagtggagatatccagttgatgcttggatatatggacttacagctcagggggagctagaaattgaaatttgagaatcatcaacctatatttataatgggtgaaatcaataagtcggaatcaaattacctggggaagcatgcagatttgtttaaaaaggaagaggcctgagaacccaaccctgaanc

SEQ ID NO: 464850 - DNA, 2290 bp, Homo sapiens
gggaggaggaggaggcggctcggatggctggctcggctctcgctcgctctccctcccatgggcaagtccggctcacaaccctgcttctcccgctcactcacagcccccttggctctccctcctcctcctccttcccctgcgggatccgctcgccgccgccgccgccgccgcagacggcaagtcgtggcagccagacgtcggcgcgtaacccggcgctccgtgcctgccgccgcggcggccgccgagcgcgctctttccgcccccttctcgcgcgtgagcgcgccctatcggctcctggcgcgtcaacattccgcgggccaggccttggggcgcgtctgaggagggggatgtctgtggcctctccgcccacacttcctccacccaccgcccacagcgccccagaaggacctattactcgtttggcttctgaaggccgaagccaggctctggcggggatagaaccctgaagggcctgcgccagctccaacttagggcccttatcttttgctgcctcttacgtattgtaggcagtgcctgatggctgagaagaatcgcagaggactagaaaaggtttgagtctgaaattatctggcacagaggattaaagctcagaaataagtgattgcgaaacagttcaacttccctgttaatgacaacaacaacagcaacacgcttattaattcctagctggagcatcaagcttatgaagatttccaagactttattgttgacccttgttgaagagaactctacttggcttctttcctggctttcctaaattgttcacatacaagataaactaccgtcattcagacttacagaagtgagaagacaagctgaaccaaatgtaaaatggtagcaatttacagatgtcagaactaacatgtggatgaacttagagatggagaagaaagctgggcttttccaaagagtggatctatctgaactggatagcactattgaactttgttgcatattttgtggtagctctaaaactcctctgcttgcttacatacaaccagacaccagtgccttctgaagctaatccaggccatttttataacctaatgcagtagcactttgcaattagatgaagaagatcggtgggatttctttctgtggtgattaaaatgtgtcaggggaagaaatcaagacaatactccaagtgaaaaatataaagtcagttatttctttaatattttgtgttatagtaatcatttttatattttgagcatactttttcttgtctacttaaatactcaaaattaattataaaatgtaaatgtaagcacaatgagataccatctcatcccagttaaaatggcttttatcaaaaagatagggaataatgaatactggtggaaggatgtggagaatggggaaccctcgtacactgtcaatgagaatgtaaattagtacagccactatggaaaactgtatggaagtgcctccgaaaacaaagtagaactaccatgtgatccagcaattacactagtgggtatatattcaaaagaaaggaaatcaacatattaaagagatagctgcattctcatgtttattgaagtcctgttgaaatagccaaaatatggaatcaacctaagtgcccatcagtggatgaatggttaaagaaaatgtgattgatatgcaatggaatattattcagccataaaaaagaatgaaatcctggcggggcacagtggctcatgcaagtaatcccagcactgacctcatgaagacagagagtagattggtggttaccagaggttgagaaggggagaggagaggagggatgaagagaggttgattgatggatagaaatatacagtttgataatgataaatcagtagggtgactatagtttataataacctattgtatggttcaaaatagctaaaagagaataattgaaataacgtaagacaaaaatttaagatgatagatatcccaattacactgatttgatctttacaaattatatgaatgtattaaattattacatgtatccccaaaatatgtacaagtattttgtatcaataaaaaataaaatttaagataaagtaaatgtaatgattagcttatatttcctagatcggaaataaatatttacttaagtatgtttatgatgaagagtttttttatattactataaaaatagacaccttacataaacatattacagttggtgtttagatggctcttttttttctggccttgaatttctggaaagtagtctgggcaacaagagtgaaactccgtctcaaaaaaaaaaaaaaaaaaaaaaaaaaaaaaa

SEQ ID NO: 464851 - DNA, 704 bp, Homo sapiens
cgcccccttctcgcgcgtgagcgcgccctatcggctcctggcgcgtcaacattccgcgggccaggccttggggcgcgtctgaggagggggatgtctgtggcctctccgcccacacttcctccacccaccgcccacagcgccccagaaggacctattactcgtttggcttctgaaggccgaagccaggctctggcggggatagaaccctgaagggcctgcgccagctccaacttagggccctgtgcgtcgttgcgacttctgctaccaccctatcacgcggcacccccgccccaactccgcccgggtctctgaagaggcaataggcctttcatctccggggaaagtctcaccttggccctcagacacccgccaagaggggtcggaaggacagaattagcatagagaagagtggctagagcacttttcaggctctggccccaggaatccttgacaggaagcgtggggttgctgcccagcctcccacgcagtgtaatatgttgaagccgggcccctttgagggaatgcgacttccttgggccgagggggaaagggtaaaagttaattttcataaaatgctatgcaagggctaaatgtgaaattataaaatgtcctttaagacagtcttcttgaaatcgtatcaagtttgacaagatttttggtgcacggtaacgcttttgctcgctttctacgctgtcacgtctcca

SEQ ID NO: 464852 - DNA, 2571 bp, Homo sapiens
gggaggaggaggaggcggctcggatggctggctcggctctcgctcgctctccctcccatgggcaagtccggctcacaaccctgcttctcccgctcactcacagcccccttggctctccctcctcctcctccttcccctgcgggatccgctcgccgccgccgccgccgccgcagacggcaagtcgtggcagccagacgtcggcgcgtaacccggcgctccgtgcctgccgccgcggcggccgccgagcgcgctctttccgcccccttctcgcgcgtgagcgcgccctatcggctcctggcgcgtcaacattccgcgggccaggccttggggcgcgtctgaggagggggatgtctgtggcctctccgcccacacttcctccacccaccgcccacagcgccccagaaggacctattactcgtttggcttctgaaggccgaagccaggctctggcggggatagaaccctgaagggcctgcgccagctccaacttagggccctgtgcgtcgttgcgacttctgctaccaccctatcacgcggcacccccgccccaactccgcccgggtctctgaagaggcaataggcctttcatctccggggaaagtctcaccttggccctcagacacccgccaagaggggtcggaaggacagaattagcatagagaagagtggctagagcacttttcaggctctggccccaggaatccttgacaggaagcgtggggttgctgcccagcctcccacgcagtgtaatatgttgaagccgggcccctttgagggaatgcgacttccttgggccgagggggaaagggcagtgcctgatggctgagaagaatcgcagaggactagaaaaggtttgagtctgaaattatctggcacagaggattaaagctcagaaataagtgattgcgaaacagttcaacttccctgttaatgacaacaacaacagcaacacgcttattaattcctagctggagcatcaagcttatgaagatttccaagactttattgttgacccttgttgaagagaactctacttggcttctttcctggctttcctaaattgttcacatacaagataaactaccgtcattcagacttacagaagtgagaagacaagctgaaccaaatgtaaaatggtagcaatttacagatgtcagaactaacatgtggatgaacttagagatggagaagaaagctgggcttttccaaagagtggatctatctgaactggatagcactattgaactttgttgcatattttgtggtagctctaaaactcctctgcttgcttacatacaaccagacaccagtgccttctgaagctaatccaggccatttttataacctaatgcagtagcactttgcaattagatgaagaagatcggtgggatttctttctgtggtgattaaaatgtgtcaggggaagaaatcaagacaatactccaagtgaaaaatataaagtcagttatttctttaatattttgtgttatagtaatcatttttatattttgagcatactttttcttgtctacttaaatactcaaaattaattataaaatgtaaatgtaagcacaatgagataccatctcatcccagttaaaatggcttttatcaaaaagatagggaataatgaatactggtggaaggatgtggagaatggggaaccctcgtacactgtcaatgagaatgtaaattagtacagccactatggaaaactgtatggaagtgcctccgaaaacaaagtagaactaccatgtgatccagcaattacactagtgggtatatattcaaaagaaaggaaatcaacatattaaagagatagctgcattctcatgtttattgaagtcctgttgaaatagccaaaatatggaatcaacctaagtgcccatcagtggatgaatggttaaagaaaatgtgattgatatgcaatggaatattattcagccataaaaaagaatgaaatcctggcggggcacagtggctcatgcaagtaatcccagcactgacctcatgaagacagagagtagattggtggttaccagaggttgagaaggggagaggagaggagggatgaagagaggttgattgatggatagaaatatacagtttgataatgataaatcagtagggtgactatagtttataataacctattgtatggttcaaaatagctaaaagagaataattgaaataacgtaagacaaaaatttaagatgatagatatcccaattacactgatttgatctttacaaattatatgaatgtattaaattattacatgtatccccaaaatatgtacaagtattttgtatcaataaaaaataaaatttaagataaagtaaatgtaatgattagcttatatttcctagatcggaaataaatatttacttaagtatgtttatgatgaagagtttttttatattactataaaaatagacaccttacataaacatattacagttggtgtttagatggctcttttttttctggccttgaatttctggaaagtagtctgggcaacaagagtgaaactccgtctcaaaaaaaaaaaaaaaaaaaaaaaaaaaaaaa

SEQ ID NO: 464853 - DNA, 1716 bp, Homo sapiens
  misc_feature (2)..(2): n is a, c, g, or t
  misc_feature (7)..(7): n is a, c, g, or t
  misc_feature (9)..(10): n is a, c, g, or t
  misc_feature (12)..(14): n is a, c, g, or t
gncaaancnnannnagagcaaggccctaactattcgattctatgaaggctgagagaggtgaggaagctgcagaagacaagtttgacactagcagaggtgctaaggtgggaacccatggtgtgcactgggagcacagaggagggacctcttgcccggtgctaagggaaagggggtcagaggaggcctccccaggaaaggtgacatccaatccaagtcctgatagagagtgggggctaggccagcaaagagatgtgtggaaatgcatttcaggcccgtggaaagtttgtgagatgggagagcatgactcattcatggaaccgcagttatggtttacctgcaaagttcctagtcctaacagtagttcaggaatccacagatgtctgaagtggaaatttctaggaaggggacttccatccagatggcattttccagtagcagaaagagaaaggaacgatgtgactgttagtgcaagcactgtgctgggaactccacgtatgctatgaattcaatctgtacttaaaaataagttttactgagtaccttctaaaaggttttgaattgatatcatatcactttcaatgtaaagaaataaataagtcttcagtactgcttcccttaaagtcttgcaataaccttatcttgagctataagcacacacaaatgaagtatattccttcatttgatcccatttttctttttcccacatttctctaaaataaaccaacataataaagtcataatttggagttctggctaaattaaagattgacacacaatgtcattactcttcattctttgcttttgcaagtcacgtgtgagaaagaaacatatttctatggccttttgactgcccttgataaaatctgtacttagggaaatagcaatatcaataaatgctaaataatattaacacaatgtatgcaggggtttttaagcttcacagaaaaaaaaatttaagacatgaatttccaggaaaattattcttgtaactatcccaaatggtttttctttccatcaaaagaacaaatggaaaaaagtgcaaaagccaaatcaaacaaaatccttagtgtgaaatatattttggagcatgtggaattaaatttgcattttcaaataaaaacaaatgcccgtttaaaaagtcatctaacttttgtcctacgaagacaaccagtaaaatatactgtttcccttttcccagcatactcatgtttgggaaaacatgattatctgaagagaaatttacttttactaaattagagtttgaggggggagtgtggaaggaataattacagattatccttttattcaatctcttctcttggaaagaagagaagaaatgttgaaagccagagaacttttctaaaacgctgtagggaattttttttttctgtaaatatccaagtccaaaaggagatttgcaaaatgtggagttggagatttgaactcatacaatatttcctaatacaaataaaaatctgaaccttttaatggcgacacagtccacaccatgaatggtcaaaatcactggagctaatgtacaggaaggggttcctcagggaactgtggcaaattttagcatcttcctttccttttagggactggacactcatccttaggacttgagaatcatatgtgaaaattatatagacttcccacagtctactgacacattacagagatactggaaatattaaccacacatgttgtctacatact

SEQ ID NO: 464854 - DNA, 3395 bp, Homo sapiens
gagcccacctgtcccactctgggccactccagcgctcgcccagagaaggctccccacatgcccttctcagtttggagaccactgagttagtcaggcccctgggcctcagggcacctccctgcagggtccctcaaggtgtccctgagctcatgtctgtgtgagggctgcagtgggagtcagctccagggacgctggcgggagggcacgatgccccagctgctccccaagcaggcactgggccccgccctggtcgccatcctgcaggcagaggggaagcatggcctcggtacaggagggcgctgggccttcctcaccagccatttcccgattttcctgtcaaccttcagcagacctgaagcacaagaaaggcaggtggagaagccaggagaagccgcagctctgagctgcagcaggtcactcagcacgctccaccgccctggccaccgccactgcacgtgggctggggagagagggctggctcggaatcctcggagaagcacttccgaccagcgggctgtgctgacaagccccttgagaataaaaaatggtacactcagtggtttttgtgaacgtgcgcaaggcggatttgaaaagggtgaggcgagagtgtgacagctgctcccgggacttgagcgtagaccccgtggcctctgcagagcttcttcttcctgtccattgctgagctgtgtttccattgtatgggttccaacgtggccccaagattcccgccctgttaggttgttagccatcttatatggcagaaaggatattttcccgtgtgatcaaggcacggccgaaataaccacctttctccactgaattgcatttgcatcttctttaaaattcccttgaccatatatatttgtgactctatttctagttgttttcagttgatctttgccaatcttgatgtcattactccattctcttgattttgtagctttaaataagtcttgaagacagcataagcccttcaactttgttctactttttcaaaatagttttggctcttccagttcttggcattttgaaataaattttagaatcatcaatttctaaagtctatagatccatttgggaaaactgacatcttataaaactgagttttctaacccacagacacttacttacgtgtttaatttctctcagccgtattttgcagttttccatctacagcccttgtacatctttgctcagattcagccttgagtgtttcattttttatgtagtgtaaatagtgtttttaaatttccatttccaacattttgttgctgataggtagaaatacaattgatgcttacgtattgatctcatatcttggaatcttgctggaatcacctattgattatagtgctcttggtacagattctgtagaatttcctacatagatgatcacattatttgtagataaaaacagttttattccttccttttcaatttggatgccttttgtttctttctttcttttgtcttattatactagactgaacctcccgtacagtgttgaatagaagtattggaagtggattgctgggtattcgtggacataaagatggcaacagtagacactgaggactactagaggggagggaaggaggaagacaagggttgaaaaactattgggtactatgctcagtacctgggggacaggatcattcgtaccccaagcctcagcatcatgccatatacccatgtgacaaacctgcacatgtaccctctgaatctaaaataaatgttgaaattataaaagaagaaaagaaagtggatcaccttgccttttcctgatcttagggagaaagtattccaattttcactgttaagtatgatgtaagtgcaggtttctcaccgatgccttttatccagttggggaacttctcttctattattagttggctgagagtttttattgggaatggattttggattttgtcaatgctttctcacatctatgagatgattatgtggtttttcctttagtcttttaaaatgataaattgcaaaggttctgtaactgccacctctgtctagttctaaaacattttcatcacccccaaagaacattttatactcattagcagttactcactactaccctctcctgccatgacaaccagcagcctgtgttctttccctgtgtatgtacctattctggatatttcatataaatggaatcctgtggcttgtggcctttcgtgtcaagcggctttcacataacataatctttctgaggttcatttatgcagtgacatgtatctgtacttgattcctttttatggctgaatatattccattgtatgtctgtatcacagttatttatccatgcatctgttgatggacatgtgggttgtttcccccttttggctactgaagatagtcctgctatgatcactcatgtacaagtatttgtttgaggatctgttttcagttatttggggcatgtaactgggagtggaattgctgggtcatttgctaatgccatagttgactttttgaggaactgtcaaactgtcctttcacattcccaccagcaacacacaaggtttcccgtttctccacatccttgtcaacacttattactttctgttttgttgattatggccatcctagcgggtgtaaagtggtatttgattgtcttgtgatttgcattttcctaatgactaataatgtggaatatctttttatattcttcttggccatttgtgtatctcttttggaaaaatgtctatttaagtattttgcctgcttcttaaaaaatggggttatttgtattttcttcaagttataggagttatttatatgttcagaatactagactcttacaggtgtataaatttgtgaatatctttccatttatttagattttctttaatttctcttaaataatattttatagttttcagtgttttctcctgagagttttatagttttagctcgtatatataggtctctgatccattttgaattaataattatatatggtaagaggtaggggtccaatttgatttttttgcatgtggatttccagttgtcccagcaacatagagactgttttttccctcattgaattaatgatgttggctcccttttcaaaaatcaactggccagtaccacactgttttgattactgtagctttgtagtaagttttgaaatcaggaagtataacatcacctaatcacaggagtgacatccatcatattcacagtcctgcctatacctaagaggagaggggattgtatggggtgtgtacaccagggagtaggaatccagggccatcttagaactcttctgaccaccacagcttgatcccagtctccctccaggtgatagtgagaggtgaagccagctggacttcctgggtccagtggggacttggagaacttttctgtgtctagct

SEQ ID NO: 464855 - DNA, 3170 bp, Homo sapiens
ctgagcggcagtggaaggagggaagagccccgcctttcagccgaacgcaccaattaaaggtacaaaaaaaaaagtttctcagtacctcgtcccggactgacggactctcgcgagaattcgtggggctccgactgtttccgcgcagatatcgcgaggcgattggtagccgggggagggctgcgccgtggccccgcctttccggagcgcgggcgcgcggtggcgggaatttcgcctgtttgcggtttagaccccaaagattcctgttggtggtctgggtcacaggaggcaggtttcgggagctggaaatgtgagcgggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttatgcattaaagaattatgggttctacttattcatcttctagaccacagaagtaaatggtttgtctcggaaagttatggaggccaagaagtcccgaatctgaggttggcaagctgaagacccagaggagctgatggtatagtttccagtctcagtccaaaggtctgcaaaccaggaaagccaatggtgtaatttccagtctgagtccaagtctgaaggcaggaaaagaacagtgtttcagtatgaagcacagggagtcttctctaccctcggaggactttttgttgtattcaggccactaattgattggatggcacccacccatattagagagggccatctctttactcagcctaccaattaaaatgtaactctcaacgagaaaacctttatagacacactcagaataatatttaaccaaatatcttggcatcctgtggcctgttcaagttgacacataaaattaaccattctatttgtagttgtacaatagaatgaggaagatatctgaactgatacggaaaacgcagcattgaccaaagaagcaagttacaaaagaattagaaacaagccgcttgagaatacagacatgcatttaaaaaaaacaaaatacagatgaagccacacaatatataatataggctggtatacctgtgtggcgaaacaaaaaagcaaggaaatgatttatcatgaaagtcagcaaaattgttaactactggatggaggaggaagatgtggtgacctgtaaggtacttctaaagtactatttatgttctgattcttaacctgggcatttttattatttcagttttatatatgtgttttgtcttttgtatatatgcttcattataaaaatagagaaaaaccacgaaatcaaaggttattgaaactgtcttaatggaatcaaattacttctgtttctatagtcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagagctgttaatgtagtgcttcatggcctagaggtcagacttgacctccttttaaaatagttttaaacatgctgttcatcacatttttaaacatattgtatggaagccctgtaaagttttgtaatatgttatcatttttgtaagagtttatggagaattataataaataatattttggaatttgggaaatatttttcttttaagaaataaagattatttaaaacttgaagaggaataaaaaatattgtagtataatattgctttatatgtgtgtgtgtgtgtgtgtgtgtgtgtgtgtgtgtgtgtgtctgtagtagctatgtctttggaaaaattttaattgcttgaaattttcttttacccattatctgcattaactcttacttttttaggaaacataaaggcatttagttataatatgaatcacataattatgaactaaaaattttagcttagaatgccaaagaattctgcatacataaattggatcagaaacaaatctattatctttttataatctttcccataatccctgtaaaagttttgtttattgtattttgtcctatatcatgttcattggttgtcctcattttttttgagaacatattgatttagtaacttaaaaagttttttatgtatattttttatttcagaatgaagggaattactaaaaagtggttgtgaaataagatgcatattacagtggccattgtcatttgtatcagttactaattcagtcttaatgctttaaccaaatccagagaatttcagtaaagtctggataacattattattctattgggagttactgaatctgagtcagtaactaggggtttaattttcagttaggttgtaactgcttgtgttctttaaattgctttctcattgacccatgtttctgttgtatttaataatttttaaactccctttcagctctaacagtgtatgaatttatggttttgcactcagctggttttaagttacagaatatttcttaagaagctttaaagg

SEQ ID NO: 464856 - DNA, 801 bp, Homo sapiens
tttaaacataaaggaaaaaatctccaagtcctctaggcacaaagaccaaacaacttataagagcaaaataattttattggcactagacttgcaaagtcaacttaaaacaaggcctcaatgcagcatttaaaatgactcaatgaaaaagtgtgagccaaggattttgtaactttgaccctagcaatcccacttccaggaatttactctaaatgtgtaccctccaaaattaaaatgcatatgcatacgtttatttattgcagtattgtttttataatagtatagtagaaactaaattcttatatataaaagagtagttgaacaaaccatggtatatctgtactctgaagtattattctgtattagtgtgtgttctccagagaaacagccaataggatatatagatatatatatatatataagatttattataatgaattggctcgcagagttatggaggccaagaagtcccgaatctgaggttggcaagctgaagacccagaggagctgatggtatagtttccagtctcagtccaaaggtctgcaaaccaggaaagccaatggtgtaatttccagtctgagtccaagtctgaaggcaggaaaagaacagtgtttcagtatgaagcacagggagtcttctctaccctcggaggactttttgttgtattcaggccactaattgattggatggcacccacccatattagagagggccatctctttactcagcctaccaattaaaatgtaactctcaacgagaaaacctttatagacacactcagaataatatttaaccaaatatct

SEQ ID NO: 464857 - DNA, 2531 bp, Homo sapiens
atgagcttcatggattactcttgtatattggacacctatctgaacttcccagtgttaatataggagcatttgtaaatcaaaaccagattaagctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttatgcattaaagaattatgggttctacttattcatcttctagaccacagaagtaaatggtttgtctcggaaagttatggaggccaagaagtcccgaatctgaggttggcaagctgaagacccagaggagctgatggtatagtttccagtctcagtccaaaggtctgcaaaccaggaaagccaatggtgtaatttccagtctgagtccaagtctgaaggcaggaaaagaacagtgtttcagtatgaagcacagggagtcttctctaccctcggaggactttttgttgtattcaggccactaattgattggatggcacccacccatattagagagggccatctctttactcagcctaccaattaaaatgtaactctcaacgagaaaacctttatagacacactcagaataatatttaaccaaatatcttggcatcctgtggcctgttcaagttgacacataaaattaaccattctatttgtagttgtacaatagaatgaggaagatatctgaactgatacggaaaacgcagcattgaccaaagaagcaagttacaaaagaattagaaacaagccgcttgagaatacagacatgcatttaaaaaaaacaaaatacagatgaagccacacaatatataatataggctggtatacctgtgtggcgaaacaaaaaagcaaggaaatgatttatcatgaaagtcagcaaaattgttaactactggatggaggaggaagatgtggtgacctgtaaggtacttctaaagtactatttatgttctgattcttaacctgggcatttttattatttcagttttatatatgtgttttgtcttttgtatatatgcttcattataaaaatagagaaaaaccacgaaatcaaaggttattgaaactgtcttaatggaatcaaattacttctgtttctatagtcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagagctgttaatgtagtgcttcatggcctagaggtcagacttgacctccttttaaaatagttttaaacatgctgttcatcacatttttaaacatattgtatggaagccctgtaaagttttgtaatatgttatcatttttgtaagagtttatggagaattataataaataatattttggaatttgggaaatatttttcttttaagaaataaagattatttaaaacttgaagaggaataaaaaatattgtagtataatattgctttatatgtgtgtgtgtgtgtgtgtgtgtgtgtgtgtgtgtgtgtgtctgtagtagctatgtctttggaaaaattttaattgcttgaaattttcttttacccattatctgcattaactcttacttttttaggaaacataaaggcatttagttataatatgaatcacataattatgaactaaaaattttagcttagaatgccaaagaattctgcatacataaattggatcagaaacaaatctattatctttttataatctttcccataatccctgtaaaagttttgtttattgtattttgtcctatatcatgttcattggttgtcctcattttttttgagaacatattgatttagtaacttaaaaagttttttatgtatattttttatttcagaatgaagggaattactaaaaagtggttgtgaaataagatgcatattacagtggccattgtcatttgtatcagttactaattcagtcttaatgctttaaccaaatccagagaatttcagtaaagtctggataacattattattctattgggagttactgaatctgagtcagtaactaggggtttaattttcagttaggttgtaactgcttgtgttctttaaattgctttctcattgacccatgtttctgttgtatttaataatttttaaactccctttcagctctaacagtgtatgaatttatggttttgcactcagctggttttaagttacagaatatttcttaagaagctttaaagg

SEQ ID NO: 464858 - DNA, 1093 bp, Homo sapiens
ggaacttccagagccggtcacagaggccagatccacgatcaggtgcatggcaggggcttgtccgcaggaccggaaccttggtgagcatcagcgatgggcactgtgtttccccaagatctttatgtctcattggacaacgtgaagattcaacttccagggctgctcagtagagccaagtctggaaaacaagctcgtgggcaccacatcacaagcacgttttccctggagcccgcggacgagccagggctcaccacccccgcgacaccgcaggcctctgtgcggagactgtgctcaggcccagcgcttgcgctggagaaaaggcggagacattcagaacccaggggattccaggctgccttctccacaagggtcaggagtccaaacacagtctctgctgctctccacgcacggcaatgggaaggcagccctttcccctccatcactccggggagctcacgtgcggacggggtcctctgtagcatctttaaattggaggtacctcactccggattctattaaaatcgtaatctctagaagatggattcagcaaatgccaggcgtggagccatgaatgtttccataagaaacaagaaaaatagaaagaatgtgtgttagccagacgacaccttgatggcacccctgccacctccccagccctcctcagtggcaaagtgatttagctcagttgggcttctccaaaatggaaatagtcacttgtttgagcaaataaatgtaatgaaagttgttccggaaaaattctagtactctgcactaatacatatcatcttaaaaacttatctctgaattgtttccaaatgacaaatgtgtaaagtttctaagtactttttgtttccttatccttgtagtggaagatactacattcaacacagacgtactgtgtgcctcctgcgtgtgaggcctggtgctcatggcgcgtgtccttgcatgcaaaattctactcttcatcttgacgtttctagacattcagctgttcctcaggaaacgatttaccttccctctgccttttctgtaaaatgcatggactgaggaattactaatgcataacactttgtttgctggataccaagtagac

SEQ ID NO: 464859 - DNA, 678 bp, Homo sapiens
ggaacttccagagccggtcacagaggccagatccacgatcaggtgcatggcaggggcttgtccgcaggaccggaaccttggtacctcactccggattctattaaaatcgtaatctctagaagatggattcagcaaatgccaggcgtggagccatgaatgtttccataagaaacaagaaaaatagaaagaatgtgtgttagccagacgacaccttgatggcacccctgccacctccccagccctcctcagtggcaaagtgatttagctcagttgggcttctccaaaatggaaatagtcacttgtttgagcaaataaatgtaatgaaagttgttccggaaaaattctagtactctgcactaatacatatcatcttaaaaacttatctctgaattgtttccaaatgacaaatgtgtaaagtttctaagtactttttgtttccttatccttgtagtggaagatactacattcaacacagacgtactgtgtgcctcctgcgtgtgaggcctggtgctcatggcgcgtgtccttgcatgcaaaattctactcttcatcttgacgtttctagacattcagctgttcctcaggaaacgatttaccttccctctgccttttctgtaaaatgcatggactgaggaattactaatgcataacactttgtttgctggataccaagtagac

SEQ ID NO: 464860 - DNA, 711 bp, Homo sapiens
tctggtggagagctgattttcatgtttgtgccctgacaggagatgtctctgtgttgttgatgccaaaaaagatccttcacaagataaagtcccaggctttgcggcaattaacagagcataattctttacatatttatgaggttttccattttatatataacttcttgcacctttgtaatgttatggtatttgacccactctgtgagttaagtacacctgccaccatttcacccactcagcagctttcatctcaaggattctgggacaagtttttgtcaatgaggtttaattggagatctatgagaggcatcccattgggtaccatgctgaagtcttccttgacatctatagttgcttccatatgttcctcttgggcttctgccatcagtaggagaagaacatgcctcatggcactcactggtcccaagagaatgagagatacgtggagctgagcagctacggccaatgcctgcagcctgagcaaagccattgtagctgacctgggagcaggttaatacatgcttgttaccgcatgcacctgagattctgtgattggagcctgaagatgtgtgtggctgccttgtggctatgacggctgtggctgtaaaggctctgtactgaaggcatggccacctcactgagtatgacagcagggagatgggaagagccagatttctcatgcggatatgaagacattaactgagccctgga

SEQ ID NO: 464861 - DNA, 3324 bp, Homo sapiens
gttgtttgtttcactgggacgttccccactcccggaccgggaaagttgtaaatatggggacgatcagggcacatttgctgttaattccgctggcccgcggcctgcactctccgccgggcctacgcctccccggccgcccagcaggagcccagtccccgccaccggagccggccgggagagggtacaaaaccaccgctacccaaggcggctgccaccagagaggagcgaactctagactcgcctgtggaagagacctggggccgctaaggaaacggcggggaggggagcgaggaggagagacgctgaggacctggcgccggcgccgccgccgccgccgccgaaataaagagcaggaatttacctgggcgaatcggctgcggggaacatgtagagccggggggagaccagccgagaagacaaatcgttgcttcttcttcctcctcctcctccttctcccacatagaaacactcacaaacacccgaccacgggcccgagctaccgggggggcatcgccgcgggcccgggaaccaattctcctgtcggcgggggcgtccctccctgcggcttggtggtgtcggaacaaaatgccgaccggaagtgcagctgcaggaatgactccctccgccggcgccaaacactaacaaccaccccctcttccccactccacttccgccaccgccgcagccgccgctgccgccacttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcggaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtgtggtggtgtcgacctgtcatcccagctacttgagaggctgaagggggaggatcgcttgagcccaggaggtagaggctgcagtgagtcatgatggcaccactgcactccagcctgggtgacagagtgagagcctgtctcaacaaccagaaaaaaagtatttagttttacagtattacaaagtagtgtcacattagtttaatgaggtttatttatacaaaggtgtaaaattatgggccaagtactagccttcaagtaatttcgaagtcagcgagaatactggtatataacggatcaaactttgttcaagaaccaaaggctattgttcaacgaatggtgctgagacaactgcaaaagactaggacccttacctcacatgcaaaagactgggacccttacctcacaccattttgcaaaaattagctcaaaatggatcaatgacctaaatgtaagagaaaacctataaaattctcagaaaaaaacagaaggataaatttgtataaccttggatttgacaggattcttagctatgacaacaaaaacacaagcctccagaagcaagcaaacaaaaacaccataaactggacttcatcaaaattgaaaactttagtggttcaaaagacaccatcaagaaagtgaaaaaatccacagaataggaaagatatttgcaaatcatgtatctgataagggatctatgtctataatatgtaacgaactcttaataaaaaataaccccacttaaaatgggcaatgaatctaaatagacatttctccaaagaagaaatgcaaatggccaataagtacatgaaaagatgcttgacatcaccagagaaaagcaaataaagaaactgcaaggttttcattcttcttcacttacaaggcttcattctcactatgatagccagaataaaaaagtcagataacaacaattattggcaaagatatagaggaaaactgcaaaccttatacattctgataggagtgtaaaatggtgcagccactttggaaaacagtctggcagttcctcaagtgattaaacatctagttactatatgacccagcaattctactactaggtatatacccaagagaaatgaaaccatatgtccacacagaaacttgtacacatttgtttacagaagcattattcagaatcaccaaaaggtggaaacaacccaaatgtccatcaactgacacatgcaaaagtaaaatatggtatccatataatggtatattatggtatataaaagaatgaagtactgatacatgctgcaacatgaatggatcctgaaatcattatgttaagtgaaggaagctagtcacaaaagaccatatgttatatgattgcattcaaatgaatggaatatggaaatctatgcagacagaaagtagattactggctgtttaaagctgagggtgggagcatgggtgggcaggggaatagctaaagggtacagagtttctttccgaggtaatgaaaatgctctaaaattgactgtagtgatgattgcacatatctgtgaatatactaaaaaccactgaattgtacactttaaatgggtgaattgtatggtatgtgaattctatttcaatgaaactgttaaaaaaaaaaaaaagcggggggggggaactgaatat

SEQ ID NO: 464862 - DNA, 2680 bp, Homo sapiens
gttgtttgtttcactgggacgttccccactcccggaccgggaaagttgtaaatatggggacgatcagggcacatttgctgttaattccgctggcccgcggcctgcactctccgccgggcctacgcctccccggccgcccagcaggagcccagtccccgccaccggagccggccgggagagggtacaaaaccaccgctacccaaggcggctgccaccagagaggagcgaactctagactcgcctgtggaagagacctggggccgctaaggaaacggcggggaggggagcgaggaggagagacgctgaggacctggcgccggcgccgccgccgccgccgccgaaataaagagcaggaatttacctgggcgaatcggctgcggggaacatgtagagccggggggagaccagccgagaagacaaatcgttgcttcttcttcctcctcctcctccttctcccacatagaaacactcacaaacacccgaccacgggcccgagctaccgggggggcatcgccgcgggcccgggaaccaattctcctgtcggcgggggcgtccctccctgcggcttggtggtgtcggaacaaaatgccgaccggaagtgcagctgcaggaatgactccctccgccggcgccaaacactaacaaccaccccctcttccccactccacttccgccaccgccgcagccgccgctgccgccacttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcggaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtaagcggaattttactcaaccgggacgaaattcgtgttatatgaattgtattgtgtatttgtgtgtgtaccagtgcgctaaaagtaagtaggaaaacttgcttagattattccttttgcctcaggccactcagggggccaagatcctgtcactccttttctctaggccctgcgaatggcttcccgtcttgaggggagtgagccaaagccttgactgcggcagaagtccccgcgcgccgttgagggtgggggcgggcctgccctggcatccttgcgagtaggactcttccctgagcgtcgtccacagggcttgctccttcaccttcaggattttgctcgtgtcactcggtgcttccgcggctacttttaaactgaaagttccctagcccccttctcattttatcctttggacagtctacatatccatacttgtttatcttcttatctctccttccccagtgcaatgtaagctctaagaggacaagaggttgtgtttttctgcactggtgttacggcccccgcctagaatgccacacagtagatgcgtagtatgtggttaaggaatgaatgcgattataagggccttgatgctcccccatttctgtctttaatatgtacttatatgctacagagagctttataaaagatttaaaacacgtttattacagaattctataaaaatatattgcttctaaacattggaaagccctccacaacaccagaaacccacaaatgagggataaaatttgtttttaggcttctgtaaatgagcatgcccgaggacagtgcatcaaatgatcatatccatactgggccgattatgtttgctcttctgagtctcaaactgcattcttcatcttgtcgtcctctgtctttcaaaatacattaaaagtgagaatttggttggctcagagcaaatccagcactattggaaaagttcattcagcaagtatttattgtggacatggcctgcagggatcctctgaacgccatc

SEQ ID NO: 464863 - DNA, 3128 bp, Homo sapiens
gttgtttgtttcactgggacgttccccactcccggaccgggaaagttgtaaatatggggacgatcagggcacatttgctgttaattccgctggcccgcggcctgcactctccgccgggcctacgcctccccggccgcccagcaggagcccagtccccgccaccggagccggccgggagagggtacaaaaccaccgctacccaaggcggctgccaccagagaggagcgaactctagactcgcctgtggaagagacctggggccgctaaggaaacggcggggaggggagcgaggaggagagacgctgaggacctggcgccggcgccgccgccgccgccgccgaaataaagagcaggaatttacctgggcgaatcggctgcggggaacatgtagagccggggggagaccagccgagaagacaaatcgttgcttcttcttcctcctcctcctccttctcccacatagaaacactcacaaacacccgaccacgggcccgagctaccgggggggcatcgccgcgggcccgggaaccaattctcctgtcggcgggggcgtccctccctgcggcttggtggtgtcggaacaaaatgccgaccggaagtgcagctgcaggaatgactccctccgccggcgccaaacactaacaaccaccccctcttccccactccacttccgccaccgccgcagccgccgctgccgccacttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcggaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtaagcggaattttactcaaccgggacgaaattcgtgttatatgaattgtattgtgtatttgtgtgtgtaccagtgcgctaaaagtaagtaggaaaacttgcttagattattccttttgcctcaggccactcagggggccaagatcctgtcactccttttctctaggccctgcgaatggcttcccgtcttgaggggagtgagccaaagccttgactgcggcagaagtccccgcgcgccgttgagggtgggggcgggcctgccctggcatccttgcgagtaggactcttccctgagcgtcgtccacagggcttgctccttcaccttcaggattttgctcgtgtcactcggtgcttccgcggctacttttaaactgaaagttccctagcccccttctcattttatcctttggacagtctacatatccatacttgtttatcttcttatctctccttccccagtgcaatgtaagctctaagaggacaagaggttgtgtttttctgcactggtgttacggcccccgcctagaatgccacacagtagatgcgtagtatgtggttaaggaatgaatgcgattataagggccttgatgctcccccatttctgtctttaatatgtacttatatgctacagagagctttataaaagatttaaaacacgtttattacagaattctataaaaatatattgcttctaaacattggaaagccctccacaacaccagaaacccacaaatgagggataaaatttgtttttaggcttctgtaaatgagcatgcccgaggacagtgcatcaaatgatcatatccatactgggccgattatgtttgctcttctgagtctcaaactgcattcttcatcttgtcgtcctctgtctttcaaaatacattaaaagtgagaatttggttggctcagagcaaatccagcactattggaaaagttcattcagcaagtatttattgggcacaaatgggtaccaggcacgctaattcaaaaggtgtgtgtttctgaggctagaaggccttacataaaggaccacatgtggctactttggttgctactcaattatgctgtcaagcaaagcaaatgctagtgaaatttatttttagttttcttctgaagaaaaggttcaatgaaagctgaggtcaggcttggtgtggatattttaattcaccatttagtttgctgtttgcttacacttaggttagcattagatatacttaatcatgatttttgagtactataaaacgtgagaaatcttatttcctagtggctggaaaaacaggctttttaaattaaaataagtaaatatatcagtaagctagaagctatgcaataaggctttggctatggtattacaaattttcatatttcatgtattgaatttttggacaagaaaagacagccttgataggtattttataaccattaatacaattaatcaa

SEQ ID NO: 464864 - DNA, 2701 bp, Homo sapiens
  misc_feature (1)..(2): n is a, c, g, or t
  misc_feature (5)..(5): n is a, c, g, or t
  misc_feature (8)..(9): n is a, c, g, or t
nngangtnnaggtcctaattgcaatgcatttaaatgtttgatctccaccccaaagcgaggatgcccatgtgacacgcacgttagcttactatgcatgtgcacgcccaccttcatgaccgtccgtacctcctcctataacctgctgaatatgtggcctttagtgagccagtggctcggatttatgtggtcagattctgagccggcagacacaaggacaagccagcgagaggtgtggcaggactggagattctgtgtagtatgtatgtacagcaaaagcttcagagagaaactccaggccatgcaaactcatgaactaaactctgggagaggtgctggtgatgacctggaagggaaagatgagtgtttggcacaggacgggaccgaccgaaaagagacctggattaccctgtccctgatccttactggctgtggaatccagaaaaattctcctaacctgcagtctcagttttctcatctcaaaaatggggttaatattagtgtatgtatcacattatgttgtgaagattaaatgaaataatgaacatctggagcatagtaaatgctcaataaatgtaggctgaataaaaaagagatccccagaccagcattatacaacttccaagattcctattgtatattccagtaggtagagtagctttttttaaattaatggtacagataataagttactgtgcacagaaaacacccaacaggcagtgccggcatgagtttatgatactgttcctctttcttctgtgcagactctctttatgtctatggatatgtaaatatttaattaaaacatctttgtataaaataaatggtggtataaggaaatggaaaaaaacccttacctgcagagaaaatttgtgaaatatatttttcacacagaagggagtagagtcactacgcatagaatataggcatgttcaagtttggtaagtcattccagaccttttccaagggattccactgatgtacgcccttccacacagcggatgagagctggtgttcctgcataccctcactaatgcttggatttaagatgggccaatttggtggaggtgaagtgcaatgtcaccatggtctccatctgccctgccccagtgccactgaggtgaagcatatgattatgggctattcatcttccctcctctgctaagtgacggctcaaggctcacacttgtttttttctattgggctgtttgccgttttattataatttgtagttctttatatcttctctgcatacattctttattagttttatgtaatacaaacatatctctttcagtttttgtcttttttccaccctttgttgtgttttttgatcaagatacataattaaattgattacttaagttaaaattaaactcttaaattttaatgtggtctaatttatcaagtgttttctttaatatttgtacatccttgtcttgtataatgaatgtctgtgttctaaatttgtaaagatattttcttacataaacttctaaacattttatgaatttgtcttttatagtcatttattctatctgaaattgatttttaagactggtgtaatatagaaattcacgttcattcttttccatttggataagcagcaacattaattttttaaagttttttgaattgataatacattcacacgcagcaaagtatcaaagcaatgtcaaatggcttacagtgaaaagtcttacttcccctccctcacaacccagttctccacctgtgcacctacagacaacgacttttagtcattattttataaatttccttggcatctctgtgtaagtgcaagaaaacatgaaattatatttccattttccttctttgctagactcctaagaaacttgttttttcacaattcgcagtagaccttggcaattgttcaaagtccctaccaagaccttccttgttctttttgagggatggcacagtattccattgtacagtaaagccatatctagagattttcttttcactcatgatgtaacagactggatctgcctccctccccaccttaagcaattggaatttctgaagctaaactctagaacgcaggaagctgtggagacagaagtgataacaaactccagagatgtgtggagcattctccttgagtctctgagttggtcgtgatctgcactggagtaatgtggaatgaatgaagatatgtctcttcaagccttttgcccatttttaattgggtgtttgtgttttgttattgagtcatagagttatttgtatggcctggctagcagacccttatcaaatatatgatttgcaaaatagttctcccattctataggttgtcttttcactttatttataatgtattttaaagcacaaagcttttggttttgatggagcccaatttttctatttttttcttttgctacttgtgcttttggcttcctgtgtaaaaaccccttgcaaaatccaagatcatgaagatttacttctgtgttttcttctaagagttttatagttttagctctcacatttaggttgttggttcattatgagttaattattgtaaatgatgtgatgtaagcatccagcttcattcttttgcatattggtagccagctgttccagcatcatttgttgaagaaactgtgtttcccatttgaattttattggtgtccttgttgaaaatcaattggccttagatgtatgggtttatttttgggctctt

SEQ ID NO: 464865 - DNA, 2265 bp, Homo sapiens
aaatgttagtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtggtgaaggaaggcctggcggagaaggaggtaatggaggagcagatggaggtagaggagcagccgccagaaggtgaagaaatagaaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacctccaactgctcctttccattaccctaaagctgtggatcataaagagtgttctccagaccagcagtatctgcaccacctggatcttgttagaaatgcagattttcaaaccccacccatgagctactgaaacagaactctgaaggggatatttgggaaattttcagtagtaattttggttattacgatgaatagggctgcagctggtattcattaagggcattagggatgctagacatcgtgaatgtgagggatagtgccctatataaaataattttccagctcaaaacattcatgtagatgaaaaattcattattttttaagtctagaacatagcagttcagtcatgtttcacttaacaatgagacattctgagaaatgtgtcattaggcaatttcatcattgtgcaaacatcatacaatatacttacacaaacctaaatgctatagcctactacacatgtaggctctatggtatagtctattgctcctaggctacaagcctgtgcagcatattactgtactgaattctataagcaataggaacacaatggcaagtatttgtgtaactaaacatatctaacatatgttgtgtaactaacatatctacatagaaaaactactgtaaaaagatggcataaaatattttaaaatggtatacctgtataggacacttaccattaatggagcctgtaggactggaagttgatctgggtgagtcagtgagtgagtgcctccagtactcattctgcaagttttgatgctggcactttcttgactttaccagaagatatcaacagaatattttcagggaacaaataaggcttattttccttcctcaaatggctcttaaagagtttactgattgaaacgtcaagaggttgcagttgtccaataatgtc

SEQ ID NO: 464866 - DNA, 2444 bp, Homo sapiens
  misc_feature (620)..(620): n is a, c, g, or t
  misc_feature (626)..(626): n is a, c, g, or t
  misc_feature (629)..(631): n is a, c, g, or t
  misc_feature (633)..(633): n is a, c, g, or t
  misc_feature (635)..(635): n is a, c, g, or t
  misc_feature (637)..(637): n is a, c, g, or t
gccgtgcttccctgctgcagccggcatgagggcagcagacacttccatcagtgggcgagaaatcatgtatgttgcagaaatggccagaaatctttataattcttcatggattataaaggatgctttagtggttctgcccaagcaaatactatttaattttccttttaatatgatattgcaggtatcattctttgatacagaaaattgtatttcaaaatgtgtccttcaggtggtctatatctgcaaggatataggcctccatccgaagagttcaagactttctatttctgtgcggaaaatgaaacagaaaaccgacggtaagtcaagatctttgtatttcttctcctttaccagtcctgagaaggccttcttagcaaactctcatccttactttccagctccaacttcacatcttcagttcaattctccctcttcctttgcagtcttcatagctaatactctccaggatttttgtcaatgcatccttagataactcttctagaagtgtttttttttttttttcaaatggaaaaataatttgcacatctggagaactgagggaaggtcttcatactcataagtgggagttcctcgttccactcttttcaaaaaaggttggnacaggnttnnncntnanaggccatgtggagaagttcacatgcggaggtgatgtgatggctgatctccaatggtgacacattacacggtattgctttgtgcttttgttgccgacttccctttttcctcaccttcaccttcctgggcttatgccacacaagtatcaaaacgctgattcttgagtgtatctgtttttggaggatctaagctaagacagattattttaaaatataaagatatatactcaaagaaatggctgctctggtgagtgaaactgaagtatagggaaggtgaggtagattattactttccattgtaagcccgattttaaaaattattgccatatattactttcattaaataaaaatttaaaagctaatatattgtaactaccattatatgcattttagattgctcacatacctttcaataagttttccccacagattggaggaataaactaacaattattttagtattataataatgttgtgacataaacgtctgcattcatacacattttatagatttttctggaataaaaaacccttttatgaaaagtgaaggaagatgtcaccttcagatcaatacctccttgtatcctgcttaaagtgcgatattcttgaaatggcagcaactgcttcataacagaatagcaataagccaatctatagactcatcttaatgaattatagaggaaagagaagcagataaaaaaagaaaccattttatttttatattgagtgccttttgtaaaatggaacttagggtggaattaatgatttaattaaaccacttaatgttttattaaagtcaatatggcctagagttcctgtgcaatcatcaatttatcaataaaacttcatatttgtttttgccaaagaatttatatttattgttagacatgcctgtattacagagatctaattgttttcagaaaattatatatgcccttgtattccaaaacccttccattagaggagcacaaatttctactaaaaaaaaaaaaaaaagtcaggtcaggctctgaaaccatgatttattcagcttggttactactctccatgaggagttctatttctgctctattcagcagaatacctgctcagcttctacagtgaaggaggggctcaaggtcaccaatgcaaaacccacctgaggtggatgcctcctgtaggacgcactgaagcaccaaagttctgccaggaattcattgatgaaagcagatgacatctgagataatacctggtcagactcacctgaagcccatggaggatttatctttgtttctaccaactgtacaataagattttaaaatagcacattcttaattgtctgtatttatgtatattctcctgaaaaactgttatgtaagcagattttctttaaacatgcatccaaaggaaattcccaagtcaattagttcatactaagagaatacaaacttatttaacatcaacctaagtaaaatccactggagaagataagtgtgtagcttagaattacagattgtattctctagtcaaagatacataaattaggccttaaaaagttactttggatcatgtttacttttattactgtctatctggatagataattggatgttattgctcatccctcattttctagaatgagtgttcttagtgtcaagaataaaaatggacgtatgtacatcaagtcttgttccatgtaatgctgtccttgtgtcaaggagagtaaattgtggtaaatctctgatgtctggatagcctaacactaggatgagaatactgaacttgcttaacaccaaacttgtcacctttcaaacacagtatctcatgtaa

SEQ ID NO: 464867 - DNA, 2532 bp, Homo sapiens
ctctcccaccagtaaaggaaaacagaagagtgataaaaggagctgcagttactgtatgttcagggttgctgcctcgatgaatgcttggaggcagtcgattcttctagcacatgagagggccagcacagctattcctctggcaaagggaccagttacaaattctacattttaccactatccatcagctgctgaaaagctgactgaaacctctgggtgccaacacaacttagtcccagataaagccaaagtcatcacaaaggcctgcaagaccctacaccttctgtatcccagttatttcccgctttgtccactcattccaggtctccttggtcctcaacatgtcctaaccctcctgccaagagtctttgcaggtgctggttcctctgcctggagcatggagtcctcagatccccacactggggatccctcacctccttcaagtcctgactcaaatgttaccttatccgcaagcacatccctaatcaccaccctcattaaaattataacctcgctctccatcctgctgccctgattgaatttgctctatggtctatatcagcatataacataacatacagtgtactatttgctgaatgtttctctttccctgttaaatatcagctccacaaaggcagggatttgggttggctttgttcactgttgtatctgcagcaactagaacagtgcctagcatgtagcaggtgctcagtagatacttgctgaatgaagaaataattaaatgaattagccagtttgtggtgaagattaatggagataattacaggcatataagaagtacttgctaaatgctaactgctagtgctattaatgttattgaagccatcattccaggaggtagtcaagatgaaaagcactaagttggagattttaggtaatttcacagtggatggatccacaagtattacagtttttaagatacattggaatgattgaggctgagatatattcttatgctgtgtgattattgagtttaacccattaagtaaaccatatattttatgttcaccatgtctcattagtccattcaacagctgcctgcctaaatgccaatgccaataaagctgaattgtagcaatttctggacacagaggacttaaactgacataggcatcacctccatgtgagaaaattcctttggcggactatcatcaaaatgtgtttaaactcaaataattgtgtgcctctataataataggacattttccttccaatgaaatggctttttgtccaacggtagaaatatataaattacccggattaaaaagcatgtggagacaagaggatacactcaattcctgtcactgaacatgcagtggatttagagggagcccggactgtgatgtacagtgtgccctacaggtctttctggacctaaggggaaaaaatgtccttcaaaaataacgtagttattgacgtcagtaagtctgaagtaaaacaattacgtgctttcaagtcattttgttgcaaacagctatgcattgagagtcagctgaacgtctgacattatcctagaagttgtgcaaaggcaaaaagtttaagagtcagttcctagccccaagaaatatacaaatgatttgtcaggcaatgtatgcacacatgaaacatggcaatgttcagggcagcatgtgattgactgccaaagtgtctcgagcaggaagtaccaagggaggatggagatggtaataatcagggttgggtggagaatatctgaggaaactgcacttgatttgggccttgaagagtaattgactggatttagatttatctagaaaggtcgttcccagcagaagcaacaagaacaacaagcttggagagcatcctgcactgccttactcaaaatatcaacctcctgcacatctccaaaacatcatgagctgcttgtgtgggtaggattccataggattcagcataaagtatgttcagcatggtttgttcaaaccatgtttttaaacattcagtgaataaaacgtttaacccctgaataaagactaaagtatatcttaaggatatagaattataagagaggctttattgcaaatcaagtattttatcaagtatagggagagggaaagtaaaccaaatgagttagtctgtgtttattagctgctttccccttattgtcaaaaaagggggggtgcacctcagggttggaagatgactttagcaaagtagagaagaggatttatttcctctacttttctgatcgtgcaaaaaaagaaaaaaaaaaagtaaagctcagtaagcatagagaagaaataaatacaagccttcccaaagatcataaggcaactttatttctgaaaaagaaatgtcagttttgagaactggaaaagagcaggaaaaagccaacaagagatctcaaaccaagcatcagataaaaccaaggacatatttacaacatccatagagtgcactggatgctcaccaggtaagaagaaataagagctttctagttggacaaaaaggaaaattaagtgtaacatgatgggggaaaaaaagataaattattct

SEQ ID NO: 464868 - DNA, 2215 bp, Homo sapiens
ctctcccaccagtaaaggaaaacagaagagtgataaaaggagctgcagttactgtatgttcagggttgctgcctcgatgaatgcttggaggcagtcgattcttctagcacatgagagggccagcacagctattcctctggcaaagggaccagttacaaattctacattttaccactatccatcagctgctgaaaagctgactgaaacctctgggtgccaacacaacttagtcccagataaagccaaagtcatcacaaaggcctgcaagaccctacaccttctgtatcccagttatttcccgctttgtccactcattccaggtctccttggtcctcaacatgtcctaaccctcctgccaagagtctttgcaggtgctggttcctctgcctggagcatggagtcctcagatccccacactggggatccctcacctccttcaagtcctgactcaaatgttaccttatccgcaagcacatccctaatcaccaccctcattaaaattataacctcgctctccatcctgctgccctgattgaatttgctctatggtctatatcagcatataacataacatacagtgtactatttgctgaatgtttctctttccctgttaaatatcagctccacaaaggcagggatttgggttggctttgttcactgttgtatctgcagcaactagaacagtgcctagcatgtagcaggtgctcagtagatacttgctgaatgaagaaataattaaatgaattagccagtttgtggtgaagattaatggagataattacaggcatataagaagtacttgctaaatgctaactgctagtgctattaatgttattgaagccatcattccaggaggtagtcaagatgaaaagcactaagttggagattttaggtaatttcacagtggatggatccacaagtattacagtttttaagatacattggaatgattgaggctgagatatattcttatgctgtgtgattattgagtttaacccattaagtaaaccatatattttatgttcaccatgtctcattagtccattcaacagctgcctgcctaaatgccaatgccaataaagctgaattgtagcaatttctggacacagaggacttaaactgacataggcatcacctccatgtgagaaaattcctttggcggactatcatcaaaatgtgtttaaactcaaataattgtgtgcctctataataataggacattttccttccaatgaaatggctttttgtccaacggtagaaatatataaattacccggattaaaaagcatgtggagacaagaggatacactcaattcctgtcactgaacatgcagtggatttagagggagcccggactgtgatgtacagtgtgccctacaggtctttctggacctaaggggaaaaaatgtccttcaaaaataacgtagttattgacgtcagtaagtctgaagtaaaacaattacgtgctttcaagtcattttgttgcaaacagctatgcattgagagtcagctgaacgtctgacattatcctagaagttgtgcaaaggcaaaaagtttaagagtcagttcctagccccaagaaatatacaaatgatttgtcaggcaatgtatgcacacatgaaacatggcaatgttcagggcagcatgtgattgactgccaaagtgtctcgagcaggaagtaccaagggaggatggagatggtaataatcagggttgggtggagaatatctgaggaaactgcacttgatttgggccttgaagagtaattgactggatttagatttatctagaaaggtcgttcccagcagaagcaacaagaacaacaagcttggagctgcgtttcctctgagagaacagcggtcttctgtctgctgtggcaagcaagtcacttcttcttgtagtgagaactgaaaccagaaccatcatgtgccacttcctggacacctcctattaaatattaaagtcctctcaccacagaagccggagtttagtggttaggggcacaggttcttagatatgaacatcagttgcaacctaccaactgcatgctcttggacaatttacatttctgtgtatcagctttcctttttctttagaatgagatattaatagtagcaacccagaattgtcatgaagcctaactaagtttttatatataaagagagttagaagagggcttggaatgtaacaataactcaataaatattggcctatt

SEQ ID NO: 464869 - DNA, 1849 bp, Homo sapiens
tcttccacgggccatttcggctcagactgacaagcatgaacggaacggaattattccctcttctaactgcagccacgatttggcgttttaacaccgggctcaaggtagcctgggtctctcttggccaaagagcccagggatgcctctaactccttttctaaagccggccacggaggccccgccctctgcagggaggctccggatcatgccccctgctcctcccactactgctttgcgcctgcgcggaggctcggggagtcggcgccatgaccccatcgaggcttccctggttgcttagctgggtctcggccacggcgtggagagcggcaagaatccgcgctcctggtccaggctccagcagaaaaggatttgtggcagtttacagtttatcttttaaaaatgggaaaagtgcagaagtgagccaaaggcaaataagtataacgtaaattagatgaagccaggaattgtcagtacagaaaaagcattcatgctttcagtaaaaccaacatttttaaacccattgttgttggaaatttttctcaagataatacagaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctggcttgctgccccgggctgccttggacctctactcctgggcattctggctgctcaagcagctctagctcaggtggtccccagtgtggctcgacctgccactccaaaaggtccaagttgtaaatcttggcagcactgtccagtgatgcaagtggtctcagatgctgctcatgcccccactccagagggcacaagcagtgagccttggcgacctgcacatgctgcttattctgcaggcacacagcaagagctggcaatgctgagtggaaatgtgggaccagagctgctgcagaaagttcccaacagagcagtgcactctggagccgcaggggcaggaccaccctgggacctcagaactgtagagctaccagtatgcaacaccagcctggaaaagctgcaggcacctgactccaacctgtgagagtagccatgtggactacagcaagcaaagccataggcatgagattgcccaatgttttggagacccactccctacctcagtgttcacaggatgccagcatggagtcaaaagagattattttccagcttcaagggtttttttttgtgtgtgtgtgtgatggagtctcattcttcattctgtcactctggctggaatgcatgagcctagatcacaccattgcactccagcctgggtgaaaagagtgaaactccatctcagaaaaaaaaaaaaaatcattttttaataaattacctagtttcagctattcttttataagcaacagaaaatggactaagacaatgtcatggctggcatgcagaacacttcccttctacacatctggctttgttctccattctaaccttttggggagcattttcattctgaaggggttagaatgccacaaattacatttctagtgagttatgcatgcaaattaagttctgccaattagatgcacttattgtgatttgaaagggaatgtgagggaaggctaccttcccactgctggtttttctcgctggctgatacagttgtggagaccgtgaatttgtctgcagcagcactccactctgtagttactagtcttgtgaggaccgtcatttccttgattaggct

SEQ ID NO: 464870 - DNA, 601 bp, Homo sapiens
tgggtggagctgcccaagaccatgggaacccacttcttgcattggcatgacctggatgtgagtcatggagtcaaaggagatcattttggaactttaagacttgactgccccaatgattttggacttgcatgggcctttagccctttgttttgtttcaaaggggagacgctgccaccaggagacacaacaattattccattaaactggaaattaagattgccacctggacactttgggttcctcctacctttaagtcaacaggctaagaagggagttacagtgttggctggggtgattgacccagactatcaagatgaaatcagtctaccactccacaacagagaaatggctgaggaaagagacttactggtatctacagactgggtcatcctatctacttgttttttacaattctcctctactgaggtcatcctttgctgatcatagcgaacttcccatgaggttacagctacaggctgagaagaggagccattgtagcaaagcagaaaccatggacatttgtgccacttcttcatggaccttacttgtgccttcaggacctgcctgggtttgatcatgtatataccacttacattgatga

SEQ ID NO: 464871 - DNA, 333 bp, Homo sapiens
cgggacagagcggagcagctgggcacggcgtccagggcagctagggcctgggccgcggttcggccgcgccggccgaaatggctgaggaaagagacttactggtatctacagactgggtcatcctatctacttgttttttacaattctcctctactgaggtcatcctttgctgatcatagcgaacttcccatgaggttacagctacaggctgagaagaggagccattgtagcaaagcagaaaccatggacatttgtgccacttcttcatggaccttacttgtgccttcaggacctgcctgggtttgatcatgtatataccacttacattgatga

SEQ ID NO: 464872 - DNA, 650 bp, Homo sapiens
cgtcggttccggggcggatgacccctctccaaacggcgcagcgctgcggctctcgtgagctgggaagtagggggcaggggagaggccgcgggtccagaaaccgttactggatgggccgggtgcgcgaggcgggtgccctgggcgcgcccgaactggctgagcagtggagcgggaaagggcgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcagtgagcatcccgggttgttggtaaagatcttggtgcctgggaggtcggagcttcgtctcctgaaatggtttatactagtgaaccctggcgccacgttctgtggcttataatcactttcgtcgtcgccgcatgaggaagcaaatgacaccgccccttaccctggaaaagtggctgcagccttccccggatcttagttttactcaccccgaagtcaatttctcggtaactccaccctgcaaaacctctgtgggactcatcttcagggcagagctaacagttttctttctggaaaa

SEQ ID NO: 464873 - DNA, 671 bp, Homo sapiens
cgtcggttccggggcggatgacccctctccaaacggcgcagcgctgcggctctcgtgagctgggaagtagggggcaggggagaggccgcgggtccagaaaccgttactggatgggccgggtgcgcgaggcgggtgccctgggcgcgcccgaactggctgagcagtggagcgggaaagggcgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcatcgtctctgccttgaaccttggaaacaagtgctttcaacataagcgatgtgaaggcattaaaacatgttgaatggctgtgtgcacaggatatcctacacctgcctgacatctggaatgcaggtgaagcaacctgacctgatggagccacccacactttagaagaatctcaaatacagccaaccctgatcttcctcagctgaaaatcatccatctaccaaactcacaaattaaacataacgtaaatattattacgttatgccttgtgttgtggtgttaggcatgcacagatctgggtttatccccttgtgctaga

SEQ ID NO: 464874 - DNA, 4197 bp, Homo sapiens
gtatcattgcctctcaagaagtgcttcatggtggaaaagaatttaaaggaccagtaattactcagagtttgcttaactgccttttcttttcagtgcctctttaaggcggttatcaacaaacctgcctggactggtacaggtctgtggtttgctaggaaccgggctgcacagcaggcagtgagcagcaggggattaagatgttcctgtgtcatttcttggaagcagttttgtgtctccctccaaatagtccaccacctggctgcaccccacctccatctgtcccccagctaccaggtaatagtgaatggttcagaaggtgctgctctagggcagccaggcctttagctgcaacacagaacaatgaacagcagcaatttccaactcccttcatgggtctgatgcgaggtcattttgatgaccttctagttgcacaggatagagcagtaagacagcagaaacaccgctggcagcacctggcaggggacaagagccaaccttctgataacttaagagagattctccaaaatgtggccagattgcagggagtatcaaatatgagaaagctaggccatctgaataactttactaagcagtatctgctggataacttgttgcagcttctgtatcggcacctactgctttaccttgccattttatgttacggagatgggttctttcctttaacctcgtgaaccattcacacttttcttctgcagcttcctcacctctcagccttcataacatttaagagagttggggtcttgcttgctctggagtatgcagtgtatctctgtaatgaaggctctaaactttttgtactttttgtcttgtttgttttttgttttaccatatcctttttaaaatgattttcatatatccctctggccttggtgcaagctttgtagcagcccctttctttgctatgttgccatgattttaaaatcctgatagccaaacttattagaatttgtctattctaagaaattttaaggaataccagtattgtaatatcagcagtgttgcaatatctgatagcagctattctagtcctgtctcctaccctattctgtttgggaccccctcccctcccctcctctcctctcccctcctctcccctcctctcccctcctctcccctcctctcccctcctctcccctcctctcccctcctctcccttccccttccctccccttatttcctctaaagaaaaaattggacaggaaatttttacagttatcctaccaatagggtagtgaacttttatcagctttttcttagggtccatgcttctcgtggatgtgatgtgatatgttgatcactttggttgctttatactgtatggttacaatgtttataacttcatactgagaaagaatattagcactttggagacccttcttggtcttcagtgttaaataaatgatttatcttctctttaatccatttcagttagccgcaataaatcaattaaggacattatatgtaacttttaggtatatgtagaactagaatttctgggttataaggtacatgtatgtttagctttagtagatattgctaaatagtttgctaaatgattgcactgattatacttctactattatgtataggagtttcagtctccccgtgtccccatcaacacttgctattttcagtttttagttatatcctttcttgtgtggggtctcattgtggttttaacttgtgttccccgattttgaagctttgttgttacttcatgtttagaactgctaaatcttcttattgggcttaatccttttataattataaaataaccctctttattcctaggattattcttcattgcccttttaacagttgttttatactgtaaagtatttttttttttaaatcttcttggttgtttttgggaagacagtcagaacctctcatctctgacatggccaggaatggaattctaagtccatttgaattttaataggattgccttagattaattgtattcagatagaagaaatgctttttgaatcacagactatctatatataaagcattgattagaataatgaactgtctaaataaaaattatgcttctacataaaagactttcaaaactggataatttaataaattttacaaagaaatgtcagtttggtgctatttgtttggacatcaatatttgaagtgaattcagaattcaaattatattttggtaagatagaatttttatggatagtgcctaatttagtttaagccctggtcaaaattgcaattaaatgaaaacagccttgaattatttttcctttacaatttttataaaatgtctgaattttatcagagataagtgaatttttttagtagactttttacactttatgtttattattctttctttatgaatagatgtagtcttgtaaattactatactgttctttcctaacgttttaaaagaaaaaattggtcttttaaatgacagatatttatccctcgagatgtatgggttaattaaataaatatatgctggtactgagaaatcatataccaaaacaataatataccatattgacattgtgaaaatgggtttcatctatcagtattgtgatacaaaaagttgtttaatagaattttatcaatgattaatattttgtgtattgtttaggtgcattgacatacaacagagcaacgaggtagagaggacacaagcacttcgattagtcagaaaggtatgctctatgtgtgagagtaaaaggcaaatttatggtttttatgttaatatttacatttttagattagacttttgtgaaatctttattaagattaaagactaaacttttattaaacatttttattaaagttttatattaaataaattcattaaactttgagttaattgaaaaaactgacttagaaatgaatatgaaagcttttgtagattctacagttattggagatgtatttgatttatgcttgtagaactgtattctgtaatttcaggtgaactttgtaatatgtcttaaaaatgctgtttaaatgacaaaccacttacaactactgatcaaacagatctttcttttgatcttctgtaagacttaattgtgtgtctttcattagttatattacatcctctaattgtttcatctcacaagttttattttatcaacaggacaataaatctagtaatatctgggtcaaattaattttctctaatattttattactatacaaacaaaatattttatttccactccagtaacctgctattttgaattaatttgcaaaatagtctttatttattaaacaataattagctacataattttctgtttcccaaatcaaagacatatgttacctgttttcaatattccaaatgttactgccagttagatctttaatgtgagattcatacaaaattttattacaatatatttccatcaggatttttgaaatattaaaaatagatttggattatgaactctgctttctggtatagcaacaagtgattgatgggagaggtgactagagagtaaggagatcattagatatctattgcagtagtcagagtgagagtgagggcccaagttaattaatttcatgaggagaggggagtagagataaagatgttatggaagtaaattggtaggacttggtgatgatggtatatggagagttggtcaggatcgtaaaagtacagtagtatattgactactattgtcccctctggtttaccttgtctaggtactgaaaaactgtttaagatttaggccctattctagagtaatttaaaatctcagaaacatttggtcagtgaatttatagtctgtactgttagaaaaaaatctaacacattttccatagtaatggctattaacatttgttacatcaattattagttatattaatcttttgaaatatccataagcaaaagattaaaattgatacctagatcttattctggatcttattctgttattaactacttcagtctggacaaaataggtttaagaaatgtattactaaagtaacttctttttctgattccttctgttacagatgattactgtgaatgcttccttgtttcctagttctgtgaccaactcattaattgcagttggaaatgatggacttcaagaaagagacagaatggtccgagcatgcattgccattatctgtgaactaggtcagaattttcttcaagtaatgaaaatgtaatatttt

SEQ ID NO: 464875 - DNA, 605 bp, Homo sapiens
tgacatcacctattggtaagttctgtaatgccccttgagctgcaaaaccagcaagtttttataagggatttcaaaaggggagaggggtacaaacagggagatggcaaaggagatcccagggtgatagctgcaccaggagttgagagtacccagtctagattggagctgtgtgattcaagagacagacatgttaaaggatgtttgagcaatacccctgaagccatggaatggttttgtgaatctgaggacagaatggccagaatgagagctccatgcgggcagaaatttttgtctgctttgttcaatgctgtgtccctagtgcctagaacagtatctggcacatgctcttattctatggctgacctttctgccagcaagttttccttgtgtttaaaagcactacgattgaagcataaatgacaaatggaaagatgaaatacagaagccccacacttacaagcccttccatatgccaggcatgttccttaggttatcatatttagccctcatggcctccctccctttgtctgcaacatcaagaaattcatacaatgttctcacatatttgtgggacctaaaaattaaaacaatggaacttatggaca

SEQ ID NO: 464876 - DNA, 944 bp, Homo sapiens
acaccacaatctgcaagattacttcaacacagagaaggagaccaaatttcagctaagcccctgtcaccaccactgggagcttctgggcaaggggtccgcaaggtttatgtgactttgtggaaaaaaaaacaaacaaaaacacaggatgagggtgccttagatgaggcaaagaccatctggcctcaaaaagaaaaatccattcctggatgctgaaggactggtgatggatggctcaggccttggtagttcagagcaacagccacctggaagggactttgaacatgagtcaggcaggaagaggcagccccagaggtgggcttctcctggagaagatgcacaaagaaggaatggaaaccaccagggacatgtcacgaaggagaagggaggaaccgagggggacctacagagatgagagatgacagcatagcagacccagcaaaccatctctttccctccatcatcactaccaccatccaccaaggaaaccaaaccaaagaagacagatgtaccaaaaatgaaaacacaaagtgtaagaaagaagagataataagtgacatcaatctgatgatctgtgcgagcattaaaatgtcacgggaggacaaccaggagatcatggtgttcaggaaaaccagggaagaaggcatccaaagaataaaagagtgggcaacagtgcaaaatgttctagagggaccaaataagtgcaggcctggaaaggatcacttgaaggccttggctgtcatgggtgatcttgtcacaaaggcagatcctgagggcatctatttcctatgggcttctaagctcagctttggaccccacgctgggcctgatggttccccactttcaactctaggaatctctttctggcagacttcctcacaactcctgcacacttcctgctccctcaacaggaagcactgcaaatgagctgtcctcgcgttctttcc

SEQ ID NO: 464877 - DNA, 2040 bp, Homo sapiens
ttaggaaaagagactgtccccactctgtgacatacgcagggaggagtgtcctgaaagctgggggcccccgccctgctgggggagctgataatccagtcagagaagtcagccaggaggggcacagtggggacggtggggggcctaaggagagacaaagggaaggggctgtctgctgctccttcactagcctgggggctgggaaggacactaggtcatcatgccactgggctgctcctgctttgtcagtgtgtcctgtgggtgaccttgtgcacagctgtatgattgtgtttgctgctggacgtgaccgtctgcaccgtgtcctctaacatgggctctctgtgctgctgggtggggctgacatgtggcacaccgtggcgtgtgtggttgtacgcgctgttgcggccggccctgctggcattgccatgggcagcgtgggcagcctgttggaacggcaggacttctcccctgaagagctgcgggcggcacttgccgggtctcggggctcccgccagcctgatgggctcctccggaagggcttgggccagcgtgagttcctcagctacctgcacctccccaagaaggacagcaagagcaccaagaacaccaagcgggcccctcggaacgagcctgccgactatgccaccctctactaccgggaacattctcgcgcgggtgacttcagcaagacctcgctgccagaacggggtcgctttgacaagtgccgcattcgcccctcagtgttcaagcctacggcgggcaacgggaaaggcttcctatccatgcaaagcctggcgtcccacaaaggccagaagctgtggcgcagcaatggcagcctgcacacgctggcctgccacccgcccctgagccccgggccccgggccagccaggcccgggcacagctgctgcacgccctcagcctagatgagggcggccctgagcccgagcccagcctgtccgactcctccagtgggggtagttttggtcgcagtcctggtactggccctagccccttcagctcctcccttggccaccttaaccacctcgggggctccctggaccgggcctctcaaggacccaaggaggctgggccaccagctgtgctgagctgcctgcccgagccaccacccccctacgagttctcctgctcctctgccgaggaaatgggagccgtgctgcccgagacctgtgaggagctcaagaggggccttggcgatgaggacggctccaaccccttcacgcaggtgctggaggagcgccagcggctgtggctggctgagctgaagcgcctgtatgtggagcggctgcacgaggtgacccagaaggctgagcgcagcgagcgcaacctccagctgcagctgtttatggctcagcaggagcagcggcgcctgcgcaaggagctgcgggctcagcagggcctggctccggagcctcgggcccccggcaccctcccagaggctgaccccagtgcacgaccagaggaggaagcccgatgggagtctgaagacacaacttcggggcagcgggcacaagcccaggctcaggacgcagagctggtccggctgcgcgaggctgtgcgcagcctgcaggagcaggcccctcgggaggaagccccaggcagtgagcgaattcggggccaggagcaggcgctgcgctttgagcaggagcggcggacttggcaggaggagaaggagcgcgtgctgcgctaccagcgggagatccagggagggtacatggacatggcagctcagggaacttctgagaagttatctgcagagagccccccctcactccctttggctaccctggccgtgcctggcagcccctcaggccccacagcccctggcaaccactgatctgctttcacaataaccgtatggggttttttctctttccttttttgcacacagtcctgctgtgggccttctcccctgctatatatcataaggtttttgagccgcagtttccttatgtatacgtggaggacactggcttcttgagtatctctgagtacctcctgtgtgcaaagcatatggtgttggc

SEQ ID NO: 464878 - DNA, 1520 bp, Homo sapiens
gctcccagaaattcttgggatatcatgtacggggctgcagggtccctgcttgagcaagtgggaataagacccctctggcaggaaagtaggagcacccccagggcttctgccccgggcctctgcacagactccaggggcacctgtggggctgagggcaagtggcagcacagtgcctccggccaggactggcccagccctcttccctgtgcccagctcctccccatggaagaaaggggagaacaggactggctacttgaggacaccagggactgggcctgcctgagagtgacagttctgggactctccctgctcccggtgaatgccagccagggtgtggggcccaggaggctccagtgctttcccagtccaaaggtcactaactgcccagccgctgggagtgtgtgcagggggcggttctccagccagggaggtgcaggaataaagggggtgtggggagacaggaagaggctgagcttgtggggcctgagagcctctcccctgggcagggtggggtcattgggctgccttagattcccccccccacctctcagcctgctgcctctggacaaagctctgcagaggagccccatctccttcagccccctcctgcctttggggtgcaagtttcctgaaggacttgagtgagatgtcaccaagcaacaggctgtcaggctcttggcagcaagtactggcccagcgactcgcggcagagtctctccttggggcgtctgtccttatcaggggtggatgctgtcagacttgctaatggtggaatttctggcatgtggcagggccaagtgcagtggctcacacctataatcccagcactttgggaggctgaggcacgaggattgcttgagcccaggagttcatcaccagcctgggcaatatagccagacccggtctccacaaaaaaatttttaaaaattagctgggcatggtggcctgtgcctgtagtcccagctctttgggagactgaggcaggaggatcaacttgagcccagaaggtcgaagctgcagtaagccatggtcatgccagcggagttgagcctggaccacagagcaagacactatagggaagacagccaggtgaaaatgaaggcagagaccagagttatgcatccgaaaggcaaggaatgccgggggctgccagaagctggaagaggcaaggcaggatcccccactaaaggccttggagggagcatggctttagcagcacctcaatttgggatgtctattctcctgctgcccagtgtgcccttctctcatccctccagctggtctctcactgccttcgagccccatcacctgctcgggctccccctctgtgtgtccccagttctggacacttattcagcagacctgtaagttttgctggccagcctatctccctggctagactgaaggctccttcagggcaggcctaacctgtgctagggcagcatgatgcctggtacagaataggggctccttagatgtggggtaaataaaggaatgctcgaagggtgatgggcccctgt

SEQ ID NO: 464879 - DNA, 1614 bp, Homo sapiens
gctcccagaaattcttgggatatcatgtacggggctgcagggtccctgcttgagcaagtgggaataagacccctctggcaggaaagtaggagcacccccagggcttctgccccgggcctctgcacagactccaggggcacctgtggggctgagggcaagtggcagcacagtgcctccggccaggactggcccagccctcttccctgtgcccagctcctccccatggaagaaaggggagaacaggactggctacttgaggacaccagggactgggcctgcctgagagtgacagttctgggactctccctgctcccggtgaatgccagccagggtgtggggcccaggaggctccagtgctttcccagtccaaaggtcactaactgcccagccgctgggagtgtgtgcagggggcggttctccagccagggaggtgcaggaataaagggggtgtggggagacaggaagaggctgagcttgtggggcctgagagcctctcccctgggcagggtggggtcattgggctgccttagattcccccccccacctctcagcctgctgcctctggacaaagctctgcagaggagccccatctccttcagccccctcctgcctttggggtgcaagtttcctgaaggacttgagtgagatgtcaccaagcaacaggctgtcaggctcttggcagcaagtactggcccagcgactcgcggcagagtctctccttggggcgtctgtccttatcaggggtggatgctgtcagacttgctaatggtggaatttctggcatgtggcagggccaagtgcagtggctcacacctataatcccagcactttgggaggctgaggcacgaggattgcttgagcccaggagttcatcaccagcctgggcaatatagccagacccggtctccacaaaaaaatttttaaaaattagctgggcatggtggcctgtgcctgtagtcccagctctttgggagactgaggcaggaggatcaacttgagcccagaaggtcgaagctgcagtaagccatggtcatgccagcggagttgagcctggaccacagagcaagacactatagggaagacagccaggtgaaaatgaaggcagagaccagagttatgcatccgaaaggcaaggaatgccgggggctgccagaagctggaagaggcaaggcaggatcccccactaaaggccttggagggagcatggctttagcagcacctcaatttgggatgtctattttccggaacagcgggaataagtgtctgctgctgtaagccaccctgcctgtggcactttgttacagcagcccaggaacctgacccagccaggctgctcctgctgcccagtgtgcccttctctcatccctccagctggtctctcactgccttcgagccccatcacctgctcgggctccccctctgtgtgtccccagttctggacacttattcagcagacctgtaagttttgctggccagcctatctccctggctagactgaaggctccttcagggcaggcctaacctgtgctagggcagcatgatgcctggtacagaataggggctccttagatgtggggtaaataaaggaatgctcgaagggtgatgggcccctgt

SEQ ID NO: 464880 - DNA, 5954 bp, Homo sapiens
  misc_feature (2)..(2): n is a, c, g, or t
tntctcagatgggaggtctctagccggcagcgactcaagccagcacctctcccacccggggccctttcagctcctggacatagttcctccctgtctcttcattagaacccatctgtcctgggtccttagggagcttagggatttgttaagtgtcccacttattatttattcatctctgatttactgtttttattattatactttaagttctgggatacatgtgcaggatgtgcaggtttgttacgtaggtatacatgtggtttgcagcatggtggtttgctgcacctatcaacccgtcatctacattaggtatttctcctaatgctatccctcccctagccccccaaccccctgacaggcctcagtgtatgatgttcccctccctgtgtccatgtgttctcattgttcaactcctacttttgagtgagaacatgtggtgtttgtttttctgttcctgtgttagtttgctaagaatgatggtttccaggttcatccatgtccctgcaaaggacatgaactcatccttttttatggctgcctagtattccatggtgtatatgtaccacattttctttatccagtctattattaatgggcatttgggttggttccaagtctttgctattgtgaacagtgctgcaataaacatgtgttcatgtgtctttatagtagaatgatttatagccttggggtatatacccagtaatgggattgcagggtcaaatggtatttctggttctagatccttgaggaatcaccacactgtcttccacaatggttgaactaatttacactcccaccaactgtgtaaaagcgttcctgtttctccacatcctctccagtctgtttcctgactttttaatgattgccattctaattggtgtgagatggtatctcattgtggttttgatttgcatttctctgatgaccagtgatgatgagctttttttcatgtttgttggccacatacatgtcttcttttgagaagtgtctgttcatatcctttgcccactttttgatggggctgtttttttcttgtaaatttgtttaagttccttatagattctggatattatccctttgtcagatagatagattgcaaaatttttctcccattctgtaggttgcctgttcactctgatgatagtttcttttgctgtgcagaagctctttagtttaattagatcccttttgtcaattttggcttttgttgccattgcttttggtgttttagtcatgaagtctttgcccatgcctctgtcctgactggtattgcctaggttttcttctaggaattttatggttttaggtcttacgtttaagtctttaatccatcttgagttaatttttgtataaggtgtaaggaaggggtccagtttcagttttctgcatatggctagccagttttcccaacaccatttgttaaatagggaatcttttccccattgcttgtttttgtcaggtttgtcaaagattagatggttgtagatgtgtggtgttatttctgaggcctctgttctgttccattggtctgtatatctgttttggtaccagtaccgtgctgtttttattactgtagacttgtagtgtagtttgaagtcaggtagcgtgatgccttcagctttgttctttttgcttaggattgttttggctatatggctcttttttggttccatatgatatttaaagtagttttttctaattctgtgaagaaagtcagtgatagcttgatgggcatagcattgaatctataaattactttgggcagtctgattacttttgcatatactcacatctggatctgtaaaccataggccagataaggacatttttctgttgttggttaaaaagaaatttctcgatttaccctccccttcccaccgtgctggcctgcgcgcgcggacgtgcgcgctccgccctcgggccgcctgcactgcaattggttggtgtctctgggagggatttgaaacttggcggttaaagctccggctgggacagggcggcgggagaccccgggtgaacggggaagggacatttagtttgagacggtgctgagataggatcatgaaggaagaggtgaagggaattcctgtaagagtggcactgcgttgtcgccctctggtccccaaagagattagcgagggctgccagatgtgcctttccttcgtgcccggggagactcaggtggtggttggtactgataaatccttcacctacgattttgtgtttgacccctgtactgagcaggaagaagtcttcaataaagcagtagcgccgctcataaaaggcatatttaaaggatataatgcaacggtcctggcctatgggcagactggctctggaaaaacctattcaatgggaggtgcatacactgcggagcaggagaatgaaccaacagttggcattattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgggaggatcctaaggaaggcataaagattgtgggactcactgagaagactgttttagttgccttggatactgtttcctgtttggagcagggcaacaactctaggactgtggcctccacagctatgaactcccagtcgtcccgatctcatgccatctttacaatctccatagagcaaagaaagaaaagtgacaagaattgcagctttcgctccaagctgcatcttgtagatctcgctggatcagaaagacagaagaaaaccaaggctgaaggggatcgtctaaaagagggtattaatattaaccgaggcctcctatgcttgggaaatgtaatcagtgctcttggagatgacaaaaagggtagctttgtgccctacagagattccaagttaactcgactgctgcaagattctctaggaggtaacagccacactcttatgatagcctgtgtgagtcctgctgactccaatctagaggaaacattaagtacccttcgctatgctgacagagcaagaaaaatcaagaacaaacctattgttaatattgatccccacacagctgaacttaatcatctaaagcaacaggtacaacagctacaagtcttgttgctacaagcccatggaggtaccctgcctggatctataaatgcagaaccatcagagaatctacaatccctgatggagaagaatcagtccctggtagaggagaatgaaaaattaagtcgttgtctgagcaaggcagctggtcagacagcccagatgttggagaggatcattttgacagagcaagtgaatgaaaaactgaacgccaagctagaagagctcaggcagcatgtggcctgcaagctggatcttcaaaagctagtggagactttggaagaccaggaattgaaagaaaatgtagagataatttgtaacctgcagcaactgattacccagttatcagatgaaactgttgcttgcacggctgcagccattgatactgcggtagaagaagaagctcaagtggaaaccagtccagagacaagcaggtcttctgacgcttttaccactcagcatgctctccatcaagctcagatgtctaaggaggtggttgagttgaataacgcccttgcactgaaagaggccctagttaggaagatgactcagaacgacaaccaactacagcccattcagtttcaataccaggataacataaaaaatctagaattagaagtcatcaatctgcaaaaggaaaaggaagaattggttcgtgaacttcagacagcaaagaagaatgtcaaccaagccaagctgagtgagcaccgccacaaacttctccaggagctggagggtcaaatagctgatctgaagaagaaactgaatgagcagtccaaacttctgaaactaaaggaatccacagagcgtactgtctccaagctgaaccaagagatatggatgatgaaaaaccagcgggtacagttaatgcgtcaaatgaaagaggatgctgagaagtttagacaatggaagcagaaaaaagacaaagaagtaatacagttgaaagaacgagaccgtaagaggcaatatgagctgctcaaacttgaaagaaacttccagaaacaatccagtgtgctcagacgtaaaacggaagaggcagcagctgccaacaagcgactcaaggatgctctccagaaacaacgagaggtcacagataagcggaaagagactcagagccatggaaaggaaggtattgcagctcgagtgaggaattggcttggaaatgaaattgaggttatggtcagtactgaggaagccaaacgccatctgaatgacctccttgaagacagaaagatcctggctcaggatgtggttcaactcaaagaaaaaaaggaatctcgggagaatccacctcctaaactccggaagtgtacattctccctttctgaggtgcatggtcaagttttggagtcagaagattgtattacaaaacagattgaaagcctagagactgaaatggaactcaggagtgctcagattgctgacctacagcagaagctgctggatgcagaaagtgaagataggccaaaacaatgctgggagaatattgccaccattctggaagccaagtgtgccctgaaatatttgattggagagctggtctcctccaaaatacatgtcaccaaacttgaaaacagcctgagacagagcaaggccagctgtgctgacatgcagaagatgctatttgaggaacaaaatcatttttctgagatagagacagagttacaagctgagctggtcagaatggagcaacagcaccaagagaaggtgctataccttgtcagccagctgcaggaaagccaaatggcagagaagcagttagagaaatcagccagtgaaaaggaacaacagctggtgagcacactgcagtgtcaggatgaagaacttgagaagatgcgagaagtgtgtgagcaaaatcagcagcttctccaagagaatgaaatcatcaagcagaaactgatcctcctccaggtagccagcagacagaaacatcttcctaatgatacccttctatctccagactcttcttttgaatatatcccacctaagccaaaaccttctcgtgttaaagaaaagtttctggagcaaagcatggacatcgaggatctaaaatattgttcagagcattctgtgaatgagcatgaagatggtgatggtgatggcgacagtgatgagggggatgatgaggaatggaagccaacaaaattagtcaaggtgtccaggaagaacatccaagggtgttcctgcaagggctggtgtgggaacaagcagtgtgggtgcaggaagcaaaagtcagactgtggtgtggactgtagctgtgaccccacaaagtgtcggaaccgccagcaaggcaaggatagcttgggcactgttgaacagacccaggattccgaaggctccttcaaactggaggatcctaccgaggtgaccccaggattgagcttctttaaccctgtctgtgccacccccaatagcaagatcctgaaagagatgtgtgacatggagcaggtgctgtcaaagaagactgctccagctccctccccttttgacctcccagagtcgaaacatggagcaacagaataccaacaaaataagcctccagggaagaaaaagaaacgagctctggctagcaacaccagcttcttctctggctgctcccctatcgaagaagaggcccactgaagttggagtcatcatctctacccccaatctggcttgggagatgctttccagttgcagccagaaggggttttttaaatgacttctctggatttcaggtttcttgccgttgaaaaaaaggaacaaagcattactaaaaagaaggtaacctttgttggatgttgtccctcagtctccatccccagact

SEQ ID NO: 464881 - DNA, 2238 bp, Homo sapiens
gtgacacccctggcataacccacaccagcaaataggttccctgggcagtgctttttaatactccacaaagccagtaagtagacactgagacctctcctcccgctttcagagcgaaaccagcattccttacccaggtccccacaggactcctcctgcagaacgatgcctcctttgacggtagatagatacgtcagagatgaggtcgttactcagcgcttgtcactgctcaccagctcactatcatatacctgaattcagaacatcccaacatgggccaaaagccaggccccttccttagcagaaagtaccatgaggcagggaaagctggaacggcagagggtggtggggccttgcttggttatcaggacagcctttccctgtgtttggcatttgagggtttagaaaccctcgtggagactcagcgtgcagggttcacctacaaagatcacgtggaccaagtgtgcctggaccaagtgtgcctgaagcggtgctctgcgtgggtacaaaatgtgacagcagtgtttgccagtccacttcactggcaaaggccgacactgttcatgacgtcaaaggccacggtggctttacagctacaatctcaacagcaacaagaatttaatgagggccgattatgtgcaagatactataatttgatgacaaagagccggaactagagatgtccagggcttcctgtggctttgggttgggatttttccaagcttctgtcagaggtcaattctgttattttgagaaaggtgttgcagtgagccttgtttttgtctctccctacccttgtaatgcaaaatatgggaggctttctgttcacagtcctgccctatcctgggagttgggctcccatgagtcttcctccagggtgatgcattctccgacagtagttgaagaatgtacgagattctaaaaaaacatttatctaaatgcattattcttttttttttttaactttgtgtaatggagaatttcaaacaaatatgaaagtagacagaatagtaaataaaccgccacgcacccaccgcacagctcacactatggccaatctcattactctatactcctcacccaccgcacagctcacactacggccaatctcattactctatactccacacccaccacacagctcacactatggccagtctcattactctatactccacacccaccgcacagctcacactatggccaatctcattactctatactcctcacccgccgcacagctcacactatggccagtctcattactctatactcctcacccgccgcacagctcacactatggccagtctcattactctatactcctcacccaccgcacagctcacactatggccaatctcattactctatactcctcacccaccgcacagctcacactatggccaatctcattactctatactccacacccgctgcacagctcacactatggccagtctcattactctatactcctcacccacagcacagctcacactatggcgaatctcattactctatactcctcacccaccgcacagctcacgctatggccaatctcattactctatactcctcacccaccacacagctcacactacggccaatctcattactctatactccacacccaccacacagctcacactatggccagtctcattactctatactccacacccaccgcacagctcacactatggccagtctcattactctatactccacacccaccgcacagctcacactatggccagtctcattactctatactccacacccaccacacagctcacactatggccagtctcattactctatactccacacccacagcacagctcacactatggcgaatctcattactctatactcctcacccaccgcacagctcacgctatggccaatctcattactctatactcctcacccaccacacagctcacactacggccaatctcattactctatactccacacccaccacacagctcacactatggccagtctcattactctatactccacacccactgcacagctcacactatggccagtctcattactctatactccacacccaccgcacagctcacactatggccagtctcattactctatactccacacccaccgcacagctcacactatggccagtctcattactctatactccacacccaccgcacagctcacactatggccagtctcattactctatactcctccccatgcttcccc

SEQ ID NO: 464882 - DNA, 676 bp, Homo sapiens
atacattcagctcggacccacaccacctgagtccctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccataagttccaccacactattggtggctctcgccgggcagcttggagaaggcgcaatactctccagctccaccgttaccgctaatataagtaaaggtaaaattcatacttaataaacaatttaggacagt

SEQ ID NO: 464883 - DNA, 563 bp, Homo sapiens
atacattcagctcggacccacaccacctgagtccctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacgcatctccctgtcgacagcggccgcg

SEQ ID NO: 464884 - DNA, 1015 bp, Homo sapiens
  misc_feature (170)..(170): n is a, c, g, or t
ccaccaggggcttctgtcagtctagccatagtacccagggcacaaagacttgaaacagcaacctctggggccttgtttaagtgcggcaaaaaaggccactggaggggcccatgtccccacccatgagggccgaagagcctttgcctagtctgccagcagatgggcactgnaagtctgactgtcctctcaacagatgggcagacaagcatgctcctcagagccaccatcctttcaacaagacaaaaagtgaagaatcacttgcactcccatagctccttggcctagccactgaagactgatgaggccagggcccatgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccataagttccaccacactattggtggctctcgccgggcagcttggagaaggcgcaatactctccagctccaccgttaccgctaatataagtaaaggtaaaattcatacttaataaacaatttaggacagt

SEQ ID NO: 464885 - DNA, 703 bp, Homo sapiens
  misc_feature (8)..(8): n is a, c, g, or t
  misc_feature (11)..(11): n is a, c, g, or t
  misc_feature (23)..(23): n is a, c, g, or t
caggaatncgncacgagcacgtncgaagtcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccataagttccaccacactattggtggctctcgccgggcagcttggagaaggcgcaatactctccagctccaccgttaccgctaatataagtaaaggtaaaattcatacttaataaacaatttaggacagt

SEQ ID NO: 464886 - DNA, 256 bp, Homo sapiens
gatacaaataaagaagatggacaggctttcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggat

SEQ ID NO: 464887 - DNA, 902 bp, Homo sapiens
atacattcagctcggacccacaccacctgagtccctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccataagttccaccacactattggtggctctcgccgggcagcttggagaaggcgcaatactctccagctccaccgttaccgctaatataagtaaaggtaaaattcatacttaataaacaatttaggacagtcaaaaaaaaaaaaaaaaagaagatggacagaaaatgcttttatttgacagattcctcaagagggattaatagtacacagcagtatgagtgtgtttactttttgaaacggaattatgccacgggaggggtgtaggtctgctgatactaaaataaatgcagggtttagcaataa

SEQ ID NO: 464888 - DNA, 553 bp, Homo sapiens
atacattcagctcggacccacaccacctgagtccctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagaatgcacccgtatgcccccccgaatgacccccccata

SEQ ID NO: 464889 - DNA, 1021 bp, Homo sapiens
aagttgatatccaaggctaaggggtctaactctgttgatctggctggagtgcagtagcacaatgatggctcactgcagcctcaacgtcctggaaaggcatggcaacatgatcaatcagttgcacaattgggctctaggaaatatcattagagaatcagtattcaaggtttgcacagaagctgttgctgtacgcatcctctgtcttgtggtcagcctacagagcaggatagatcagcacccaaaatttggtttgaatgtcaaggctgatgaggaaccatttacccaccaagtttctagacaccagccaagggccaatctgaccagcagactagaaggactcacagcacccaaaagttgttaccctcaaagatcatcttttgttctaatgaagcaactcttggtgggctcacagagagtctcaagacaggagctggttgccaaggaaaccaaccatgcaataagaggattagaatattcagccccaccccatgacttccagagacagaggaaaggctgaaggttgagttgattaccagtagctcacgatataatcattcatgcctacataacacagctttcataagaacccaataggacagggttcaaggaccctctaaagaatgccacacctatagaggcatggaaactctttgccactttcatctgactattgatctatatcctttgtaatgcctcttataagaaatgggcagattctagcagtgtttgtgagaaaaactgatggatcctgcagattaactatggacagccaaatattgagtaaagtgatgtctacaacagcatcagctatgcctgatatggtgttaattcacattgtgaagttccaaaatcagaagatgatacagaaagattgctctggttgcctggtttctgaagaaatcgtgtaccctgtctggatagtgtcttacttcctatccacaaagttgtgaaataatctggaattaaatggcaacctaaacaaccctagagttgcctgaacacagagccattgctgtgttga

SEQ ID NO: 464890 - DNA, 724 bp, Homo sapiens
gatcatcttttgttctaatgaagcaactcttggtgggctcacagagagtctcaagacaggagctggttgccaaggaaaccaaccatgcaataagaggattagaatattcagccccaccccatgacttccagagacagaggaaaggctgaaggttgagttgattaccagtagctcacgatataatcattcatgcctacataacacagctttcataagaacccaataggacagggttcaaggaccctctaaagaatgccacacctatagaggcatggaaactctttgccactttcatctgactattgatctatatcctttgtaatgcctcttataagaaatgggcagatgtaagtaaagcgtttctctgagctctattagctgctgtagaaattaaccaaaacgcaggaggctgtcttggaaacctcccatttatagttggtcagtcaaaagtataggtgataacctagttctcaagattggtgtctgaagttgggtcaatcttgtgggactgagccttcagtctgtgagatctgatgctgtccccaggttggcagtgtcagaattgagttaaattacaaaacactagtttggtttccactggagaatctggaatcagaaatattcttttgaatgtccatgtaaaagagtagagagaaaaaacgtatgcttttgtctttacaatatcctattgcaaatttttctaacttttacaaaccacatatgt

SEQ ID NO: 464891 - DNA, 490 bp, Homo sapiens
cagaaaacaaagatctcctgttggcactcaggcttcctcctgctctaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaggaaagctggtgaatttgttctgcaacaagcctgagctttaagaaaagactaaacggagagtggatggggccagagagggcttgccctgttcctttttaataaagatttttctcgctctttga

SEQ ID NO: 464892 - DNA, 5597 bp, Homo sapiens
cggtggcacagcagcgggcagcggcggctcaggcagctggagcctcaacagcctccagcgagcccgggacccgccgacagcccgagaaaccagccgaaggacgcggggcggggtcgccgccgccagccacggggtgctcccgtccactcgccgtcccaattgttcagtgccaacctaggtcattcccgctcgagccctcggccagtcatcagactcagtcaagaatgacaaccagggacggcttttggcgtgcatctcacagctgctcgggagccatcccgtgccggcttgcgcatgggactggcatgtgacccagtgaatccatgcagtaggcccggatgtgggtgtgggggagtcacatggcagatggagcccagaacgctttgaagtcacaagaagagaagggctttccagccacaacgagctgctggcctcctgcgggaagaagttctgcagccgagggagccggtgcgtgctcagcaggaagacaggggagcccgaatgcccgtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaagccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttacaaaaattcgatagttttttttttcccaaaatgacaaaaaatctgcacctgtggtgacaggaaggctttgaaatagaggccctcattcttctgctccagtgggcagaaccttgcataaaggctccgggtccaaaagcccacccaggcagccccagacggatggcaggaagggggactgtcagcttcgggac

SEQ ID NO: 464893 - DNA, 4516 bp, Homo sapiens
  misc_feature (4243)..(4243): n is a, c, g, or t
  misc_feature (4248)..(4248): n is a, c, g, or t
cggtggcacagcagcgggcagcggcggctcaggcagctggagcctcaacagcctccagcgagcccgggacccgccgacagcccgagaaaccagccgaaggacgcggggcggggtcgccgccgccagccacggggtgctcccgtccactcgccgtcccaattgttcagtgccaacctaggtcattcccgctcgagccctcggccagtcatcagactcagtcaagaatgacaaccagggacggcttttggcgtgcatctcacagctgctcgggagccatcccgtgccggcttgcgcatgggactggcatgtgacccagtgaatccatgcagtaggcccggatgtgggtgtgggggagtcacatggcagatggagcccagaacgctttgaagtcacaagaagagaagggctttccagccacaacgagctgctggcctcctgcgggaagaagttctgcagccgagggagccggtgcgtgctcagcaggaagacaggggagcccgaatgcccgtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaacctgttgaatcatcacccagtttttcctactaccgttcctcctcccgggaaaagtggtcctgagacatgggattgggaagactccacgtgtggagacacagcacaggagcccaccctgcccaactggcaggccagaccctccacctgtgtgacttgtggggacctttgtgctcttagaaggcactgggggcagcgacgtgcacatccttttctggttcccatgggggagatccagaaacgtcaggaccctcccaaagctgaggacactgagtgaggagcccacaagggggaagctgtggtcactgctccggacctccactgcccaggcttctctctgagcagggcagcagaggctgctttgtctgctgcaggctgaccaagagggagtcctaggcctgatccagctttcctggctcccaggacaccaggcaagcagaggacaggagtggacagtgtcctttaccatctgctgccacagactcccccactccttaatcagtgagagactgcagagctaggcagctgcctcacctgcttctcacagagggacagaggcatcctgaagcccaggttctgctgatatgcagcgatttgctccacagcattcctggctcaccaccttctttccgagcccatgtggacggcagccctggggaagggtggagaggcaggagccgggcagggcctcggcctcagccgggagagggccaagcctccttccaaaccacatgcattttaatgggcagatttcactgacaattgccctgcattccctacttgcagagcagctctccaatgtcagttctcatagcagggcgtcagtccctctgtgggcacagacttctgcccagtagtgccagacaagctccctgatgggctgctctgacccccaacccagccctctctttccaaagacaccagcctcagtgtgtagacacattctcaccccagacacagcgtctggctgagccctctctcactgacccctgatcacactctgagtgctgggcatatcacgtttggtcgtccagggaccttggaaaccttcccacatagtggctaatgagcccacagatggtcagtcaacacaggggcattggagccacagccaggagccagaaggaccactcgttgccccctagagggctgcatgtggcatcttcatcttcctctcatgtggcctggctccccaccagagcagagaccaggcctggggcttaactggtccacagccctgcagatgtggccagcgcagggctctcaggcaagatttgttcccttcctctgggatcccacatacagaaacaattctgaccacagatcagacgtgcagggaaaatctgattccttttgtaactaacctgactttacaagcctcaccccaatgggagaaaagcacaactaaatgctcaatccattgtaaagattagcacgagctgacgattttaacagtccacaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggccccctngcgancggttgttcatgaatcacggctgtgttctgaaaatgcaatttttaccatttctgcttcgcctgagggatggataaaaagcaaccccttaagaccattttgattaaaggtccaatttttgggatcatggccagaatagggcccccgtttgcaagggccccattggtttgagttacgggctttttaccgacctctaagagcttcaacaatcaccaatttctgggtcttcactctgacccatcccccgggaatttcaacggggggttgcgg

SEQ ID NO: 464894 - DNA, 336 bp, Homo sapiens
ggtacaaagtctgacatgtttattatctgcaatctattttatagccctttcttttagagcttgcgttgctggacaggattattataatttggttaaacacagaactccagtcacctacttgggttcaccccctctggagcagggtctcaggttgggccacaggcccaagtccaggtcagggccgtctctttctcaccagcactgactctcacccacagtgccgccagtcatccgtgtctatccagagagccaggcacaggagcctggagtggcagccagcctaagatgccatgctgagggcattcccatgcccagaatcacttggctgaaaaacgg

SEQ ID NO: 464895 - DNA, 6609 bp, Homo sapiens
ctcccatatcccctccgacttccctgcctggtgactgacctctagtccagcactactgcttctgctcttggggctggtgacagggagagtgggaggagggctgagctgctggacagggcaaagggggagccggagcccctcctgagagccagtcagctctcaagcaaggtggccaagtgagccctgtcaggtagggggaagctttccgggcctcaccccatacttgctacccttctagaagctgaaaatttgtttctaacagacctgcagaccttctagaggtacccctcaaggcccactgagctgtccctggattccctcttggcctgagtcattttcatcaatgcctatgactctaaactcatctgattctggccttgttctcctcctcaccccacagcatgtgctgaagaagcaggacctggatgaagacttacttggttgctcaccaggtgacctcctccgatttgacgattacaacagtgacagctccctgaccctccgcgagttctacatggccttccaacctgttgaatcatcacccagtttttcctactaccgttcctcctcccgggaaaagtggtcctgagacatgggattgggaagactccacgtgtggagacacagcacaggagcccaccctgcccaactggcaggccagaccctccacctgtgtgacttgtggggacctttgtgctcttagaaggcactgggggcagcgacgtgcacatccttttctggttcccatgggggagatccagaaacgtcaggaccctcccaaagctgaggacactgagtgaggagcccacaagggggaagctgtggtcactgctccggacctccactgcccaggcttctctctgagcagggcagcagaggctgctttgtctgctgcaggctgaccaagagggagtcctaggcctgatccagctttcctggctcccaggacaccaggcaagcagaggacaggagtggacagtgtcctttaccatctgctgccacagactcccccactccttaatcagtgagagactgcagagctaggcagctgcctcacctgcttctcacagagggacagaggcatcctgaagcccaggttctgctgatatgcagcgatttgctccacagcattcctggctcaccaccttctttccgagcccatgtggacggcagccctggggaagggtggagaggcaggagccgggcagggcctcggcctcagccgggagagggccaagcctccttccaaaccacatgcattttaatgggcagatttcactgacaattgccctgcattccctacttgcagagcagctctccaatgtcagttctcatagcagggcgtcagtccctctgtgggcacagacttctgcccagtagtgccagacaagctccctgatgggctgctctgacccccaacccagccctctctttccaaagacaccagcctcagtgtgtagacacattctcaccccagacacagcgtctggctgagccctctctcactgacccctgatcacactctgagtgctgggcatatcacgtttggtcgtccagggaccttggaaaccttcccacatagtggctaatgagcccacagatggtcagtcaacacaggggcattggagccacagccaggagccagaaggaccactcgttgccccctagagggctgcatgtggcatcttcatcttcctctcatgtggcctggctccccaccagagcagagaccaggcctggggcttaactggtccacagccctgcagatgtggccagcgcagggctctcaggcaagatttgttcccttcctctgggatcccacatacagaaacaattctgaccacagatcagacgtgcagggaaaatctgattccttttgtaactaacctgactttacaagcctcaccccaatgggagaaaagcacaactaaatgctcaatccattgtaaagattagcacgagctgacgattttaacagtccacaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaagccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttacaaaaattcgatagttttttttttcccaaaatgacaaaaaatctgcacctgtggtgacaggaaggctttgaaatagaggccctcattcttctgctccagtgggcagaaccttgcataaaggctccgggtccaaaagcccacccaggcagccccagacggatggcaggaagggggactgtcagcttcgggac

SEQ ID NO: 464896 - DNA, 4859 bp, Homo sapiens
cggtggcacagcagcgggcagcggcggctcaggcagctggagcctcaacagcctccagcgagcccgggacccgccgacagcccgagaaaccagccgaaggacgcggggcggggtcgccgccgccagccacggggtgctcccgtccactcgccgtcccaattgttcagtgccaacctaggtcattcccgctcgagccctcggccagtcatcagactcagtcaagaatgacaaccagggacggcttttggcgtgcatctcacagctgctcgggagccatcccgtgccggcttgcgcatgggactggcatgtgacccagtgaatccatgcagtaggcccggatgtgggtgtgggggagtcacatggcagatggagcccagaacgctttgaagtcacaagaagagaagggctttccagccacaacgagctgctggcctcctgcgggaagaagttctgcagccgagggagccggtgcgtgctcagcaggaagacaggggagcccgaatgcccgtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaacctgttgaatcatcacccagtttttcctactaccgttcctcctcccgggaaaagtggtcctgagacatgggattgggaagactccacgtgtggagacacagcacaggagcccaccctgcccaactggcaggccagaccctccacctgtgtgacttgtggggacctttgtgctcttagaaggcactgggggcagcgacgtgcacatccttttctggttcccatgggggagatccagaaacgtcaggaccctcccaaagctgaggacactgagtgaggagcccacaagggggaagctgtggtcactgctccggacctccactgcccaggcttctctctgagcagggcagcagaggctgctttgtctgctgcaggctgaccaagagggagtcctaggcctgatccagctttcctggctcccaggacaccaggcaagcagaggacaggagtggacagtgtcctttaccatctgctgccacagactcccccactccttaatcagtgagagactgcagagctaggcagctgcctcacctgcttctcacagagggacagaggcatcctgaagcccaggttctgctgatatgcagcgatttgctccacagcattcctggctcaccaccttctttccgagcccatgtggacggcagccctggggaagggtggagaggcaggagccgggcagggcctcggcctcagccgggagagggccaagcctccttccaaaccacatgcattttaatgggcagatttcactgacaattgccctgcattccctacttgcagagcagctctccaatgtcagttctcatagcagggcgtcagtccctctgtgggcacagacttctgcccagtagtgccagacaagctccctgatgggctgctctgacccccaacccagccctctctttccaaagacaccagcctcagtgtgtagacacattctcaccccagacacagcgtctggctgagccctctctcactgacccctgatcacactctgagtgctgggcatatcacgtttggtcgtccagggaccttggaaaccttcccacatagtggctaatgagcccacagatggtcagtcaacacaggggcattggagccacagccaggagccagaaggaccactcgttgccccctagagggctgcatgtggcatcttcatcttcctctcatgtggcctggctccccaccagagcagagaccaggcctggggcttaactggtccacagccctgcagatgtggccagcgcagggctctcaggcaagatttgttcccttcctctgggatcccacatacagaaacaattctgaccacagatcagacgtgcagggaaaatctgattccttttgtaactaacctgactttacaagcctcaccccaatgggagaaaagcacaactaaatgctcaatccattgtaaagattagcacgagctgacgattttaacagtccacaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctc

SEQ ID NO: 464897 - DNA, 2710 bp, Homo sapiens
tgtaagagtatggcaatactgttttttttcattttgtattgtttcttaggagtgatgatggctcgtcagtgttccactgcactatggggaagggagtgtcttggtggtaaacaaggcctttacccttgctaagcttggcctgctggctccttcctcagctcctccctacgtgacctgttctcatcatttagttttcagctcaactacaacctcctcagcaagaccttctctgaccatagcaatcactgccatctgcctgtgcctctttcagtgtctggttctcccaggagaatgtcagttccatgacaatggacactacaacggactctcttgctcatcactattcccagggcatagtctatacagagtgctcaggaattcctggttaaatgaataaatgactaatacatttaattttgtgaacatttattaaatttgtgttactgatgaaatgaccaacacatggttcccagtagacaggtaacaaacaaaaagcagatgtcacatttacctgaacaaggaacacatttgaaaagtgattaaccaacaagggagtaaagcctcctgcagttctgtagttccttacattggtgcagggtttgagaatttctgaagtgcttttcaaccgcttctttctttggactcttatactaactgcatgaggaaggcatgcgtggtgcaggagctcctctgcaaaggatgaaacagagagaaggagacagaagtgcaaatcaaggtgttgacagggttggaagcagcctgactactgcagaagtggctgttgggaagaagtggaagatgaggctagaagttctgaacggaaggacagagccctgtgtcatcaagattgcattgaccacaaatcacaaaaccccagttaacactgactggagtgataaggaaatttgccatctcacaaaacactgcatctgtggatacggctgggttgtttctgtgggatatcgggaaataatgtgcatagaacaaggcttggaacactaccttagtcctggtactgtgattttgatttttaatatgctgagtttgaaattacgaaggagcttaaatgaaaacattcagtcagttgttgctcgatgagagttgttttaacgtttcttatgagccagctctagacttagatattttataggattatctcatcttaaaccttgtaacaattctacgaggaaggcattgttacctgaaatttgtggatgaggaaacagaggtagagaggacttaggtaacttttcagtgtctgagcatcccagtaccctaagcaactcccccgcattcccgctattgcttgactcatccaattgcagtctccatctcaaaggggacagggctctgtgcttcagcacttcagggacagtggtagcttccacttcccacgcacccctcgcatctgctaactctctctggggttggccccaaatgcatactattggcctctgtctgtttccacctctccatcctgctcccttggatggagtgcttcatggtgactctctccctgggtcctgactcactccttctccccacagtcatgacaaactgtgttcttccttcactacttgtaatgggttctagaagctcagtccaagttagagagaaggctctaacccactggattactctaagctcactgagctggtgagagatagagccaggattcaacccaccttctttgtcctacctcattctggctccctggttgaccatcaaagtaaacacttaattcaaactctgaactcaaacactattttcggattattctctccatggtctaaataatctcagtttgatgaaatatgtaaaatggagtggaagaaatgaataacattcctatgatggctgtagggatgtcactgttgggagtggaggtcaggataggagtggtgggcaccaggaactcggagcaatggtagggagaggcagcagggtgcaggcaccacgcacaccccaggggtttaattccactgctcctcttgggggaaaaggtgtctctacctctggttatgttcctgccattgccagaatgcctgagacaccaagcacaggacccagcaggagcctcacccacaaaaccatgcgtctgcctgaaaggatgaaagacaaacgtgttttccaagttgatttcagaaaaagataagcaaagcaaagaaagaaacagtcattctgctcctcatgctacttcataagaagcagattggggatcttgtgcagcacttctaaaagttctcagtaccagtgcaggaactccagcgcccatgttcactacttcagtcatcccggtggggctccagctgggctcaaagagccctgcatttgctaaatagagtatcatcataattaaaaatggtgacatgattttacaaagttttgtgatcaatggtcctcttagataaattattagttgtgggtttttttttccttttcaactcattttcagtgtatccttctaaggaaaaaatgaaggtctgggtcagggtcagggtcagggttaggatcagagtataggttaggattcttctacaggtttggcatcctagatacaattaattcaacgagcattttccccctctggaaacctgctagtctcctggccccaggggcacctcttgctaataactctcttcctatcttatgcactgctccctctcagtcttctgtggggctccttcacttttttcaggctctacctacc

SEQ ID NO: 464898 - DNA, 638 bp, Homo sapiens
tgtaagagtatggcaatactgttttttttcattttgtattgtttcttaggagtgatgatggctcgtcagtgttccactgcactatggggaagggagtgtcttggtggtaaacaaggtaaagagaaacaggtgttttgctaaattcccttaagccatcccacatctctgacttccatccctgctctttgcagacactgaagagaaaactcaaaggattcccagcctgtggcaaacacttttgttacaaagcactggatgtatgcctttttcttgatggtagaattctgattagtttggggtaccaatgtatccagccaaacacccacattttcagcctcttttgctgctacatgtagccatgcagcatgtttcgatcaatgcaaagtatgtaaaattattttgctttcctggtaataggagacaaaagtggctgaaccctgtctttccccttaattccaatttgggtgtgatggcaggagcttcagcagcaatattataactatgaagaaatggacaagagaattacagcaatggcaacactaacatttttcataaatagcaaatattcagaaaggcaataaaaaataaaaccatgagactaacaagagaagtaataataatagtacaacagtgatact

SEQ ID NO: 464899 - DNA, 2666 bp, Homo sapiens
tacttaatttaatgacatcttcaaagcctcttgtcatatataacatagtcagaggttccggaatctcaacagttatcttctggaggccattattctgcctactacatagctctgtgaacttacatgatgaacatgctggaatttcctgttcaaataacatagatcacagagaaagaaaagggccttggaaatccattggtccagatctttcatttttaataagaagtcaattttacctaaaagttaacctgaaaggctacacgggtgatttccgttctcttctggccagtaattgggctctgcggctcctcgcgattttaccagttcccatccgtttagcaaacgcctttagcaaacgcccgtttagcaaacgcctcctccgtcctttggaggagggcggggctaaaagggagatgctgcctagtgattcgttgtggcgcattagtaacgcgactacagggggctggaaacagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagcagccagaataaagataaatgaagaattcaaaaataataaaagtgaaacttcttctaagaaaatagaagagaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaaatgcaattattacatttaaattgttagattaaaatgatatttagtcctgaaaaatattaaattggtcaaaaaaatcacagtgtatgccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaatcggtggctacattctcatcgttttaattaatgaaacttaaatggcttctcttcttccacatgtcctgtccttgacaagatgggcagtatcacaaaaggtcctggcattctaccatctaacactaggaactgtaaaatactgtttaatattcttcttgtttctcttttatctgtgtatctttgccattctattttctcagtgaatagtatgttttctcccattcactgataaattctctcatttgatgatgatacagggtttttaatttttgcaagattctcaatgcaagcattgttatgtatctagaaattatacctagagaaaaatgaaagtcgtttcaaatttgaaatttgcccttttaagagaatgctgaatgtcatcgcagtatataatcactatataaatgtgctgacttacagttattttagtgtctatatgacatattttgaggaaagttggctgacgttatttaaatttaatatatattctatattttagtgttattgaatattttatcactgagcttttttctttaacctgaattccctgttccatttttcattcatattaatttaaataactccagatttctttcttatagtcattattagtagcagatgagattaataattcacatgtttattaaagatagtggcttagaaattttaagatatattgatataggcccgggcgctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgaactgagattgtgccactgcactccagcctgggggacagagtgagactctgtctcaaaaaaaaaaaagaaaaaaaaaggaaaaaggaaaaaaaaaagatatattgatacagataggtagatatgatattgtactttcatgccataagactacacaataaagttcctgaaagttcctggctgggcgcagtggctcacgcctgtaatcccagcactttgggaggccgagg

SEQ ID NO: 464900 - DNA, 2098 bp, Homo sapiens
aagcagtggtatcaacgcagagggcccattatggccgggcttcttctaagaaaatagaagctaatgaaaataggttctgatgttgaattattactcagaacatctgttatacaaggtattcacacagaccacaatacactgaaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaaatgcaattattacatttaaattgttagattaaaatgatatttagtcctgaaaaatattaaattggtcaaaaaaatcacagtgtatgccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaatcggtggctacattctcatcgttttaattaatgaaacttaaatggcttctcttcttccacatgtcctgtccttgacaagatgggcagtatcacaaaaggtcctggcattctaccatctaacactaggaactgtaaaatactgtttaatattcttcttgtttctcttttatctgtgtatctttgccattctattttctcagtgaatagtatgttttctcccattcactgataaattctctcatttgatgatgatacagggtttttaatttttgcaagattctcaatgcaagcattgttatgtatctagaaattatacctagagaaaaatgaaagtcgtttcaaatttgaaatttgcccttttaagagaatgctgaatgtcatcgcagtatataatcactatataaatgtgctgacttacagttattttagtgtctatatgacatattttgaggaaagttggctgacgttatttaaatttaatatatattctatattttagtgttattgaatattttatcactgagcttttttctttaacctgaattccctgttccatttttcattcatattaatttaaataactccagatttctttcttatagtcattattagtagcagatgagattaataattcacatgtttattaaagatagtggcttagaaattttaagatatattgatataggcccgggcgctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgaactgagattgtgccactgcactccagcctgggggacagagtgagactctgtctcaaaaaaaaaaaagaaaaaaaaaggaaaaaggaaaaaaaaaagatatattgatacagataggtagatatgatattgtactttcatgccataagactacacaataaagttcctgaaagttcctggctgggcgcagtggctcacgcctgtaatcccagcactttgggaggccgagg

SEQ ID NO: 464901 - DNA, 2748 bp, Homo sapiens
tacttaatttaatgacatcttcaaagcctcttgtcatatataacatagtcagaggttccggaatctcaacagttatcttctggaggccattattctgcctactacatagctctgtgaacttacatgatgaacatgctggaatttcctgttcaaataacatagatcacagagaaagaaaagggccttggaaatccattggtccagatctttcatttttaataagaagtcaattttacctaaaagttaacctgaaaggctacacgggtgatttccgttctcttctggccagtaattgggctctgcggctcctcgcgattttaccagttcccatccgtttagcaaacgcctttagcaaacgcccgtttagcaaacgcctcctccgtcctttggaggagggcggggctaaaagggagatgctgcctagtgattcgttgtggcgcattagtaacgcgactacagggggctggaaacagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagcagccagaataaagataaatgaagaattcaaaaataataaaagtgaaacttcttctaagaaaatagaagagctaatgaaaataggttctgatgttgaattattactcagaacatctgttatacaaggtattcacacagaccacaatacactgaaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaaatgcaattattacatttaaattgttagattaaaatgatatttagtcctgaaaaatattaaattggtcaaaaaaatcacagtgtatgccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaatcggtggctacattctcatcgttttaattaatgaaacttaaatggcttctcttcttccacatgtcctgtccttgacaagatgggcagtatcacaaaaggtcctggcattctaccatctaacactaggaactgtaaaatactgtttaatattcttcttgtttctcttttatctgtgtatctttgccattctattttctcagtgaatagtatgttttctcccattcactgataaattctctcatttgatgatgatacagggtttttaatttttgcaagattctcaatgcaagcattgttatgtatctagaaattatacctagagaaaaatgaaagtcgtttcaaatttgaaatttgcccttttaagagaatgctgaatgtcatcgcagtatataatcactatataaatgtgctgacttacagttattttagtgtctatatgacatattttgaggaaagttggctgacgttatttaaatttaatatatattctatattttagtgttattgaatattttatcactgagcttttttctttaacctgaattccctgttccatttttcattcatattaatttaaataactccagatttctttcttatagtcattattagtagcagatgagattaataattcacatgtttattaaagatagtggcttagaaattttaagatatattgatataggcccgggcgctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgaactgagattgtgccactgcactccagcctgggggacagagtgagactctgtctcaaaaaaaaaaaagaaaaaaaaaggaaaaaggaaaaaaaaaagatatattgatacagataggtagatatgatattgtactttcatgccataagactacacaataaagttcctgaaagttcctggctgggcgcagtggctcacgcctgtaatcccagcactttgggaggccgagg

SEQ ID NO: 464902 - DNA, 880 bp, Homo sapiens
  misc_feature (880)..(880): n is a, c, g, or t
tacttaatttaatgacatcttcaaagcctcttgtcatatataacatagtcagaggttccggaatctcaacagttatcttctggaggccattattctgcctactacatagctctgtgaacttacatgatgaacatgctggaatttcctgttcaaataacatagatcacagagaaagaaaagggccttggaaatccattggtccagatctttcatttttaataagaagtcaattttacctaaaagttaacctgaaaggctacacgggtgatttccgttctcttctggccagtaattgggctctgcggctcctcgcgattttaccagttcccatccgtttagcaaacgcctttagcaaacgcccgtttagcaaacgcctcctccgtcctttggaggagggcggggctaaaagggagatgctgcctagtgattcgttgtggcgcattagtaacgcgactacagggggctggaaacagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagcagccagaataaagataaatgaagaattcaaaaataataaaagtgaaacttcttctaagaaaatagaagagaactggtccctaggaaagaccttcttgtagaaaatgtgccatattgtgatgcaccaactcagaagcaatgagttttctagaatacaacaagtctttgtactttttaactttaaaatctacaactctggcaaaaaggggtttcccccccccttttttgggggggggggggn

SEQ ID NO: 464903 - DNA, 2595 bp, Homo sapiens
tacttaatttaatgacatcttcaaagcctcttgtcatatataacatagtcagaggttccggaatctcaacagttatcttctggaggccattattctgcctactacatagctctgtgaacttacatgatgaacatgctggaatttcctgttcaaataacatagatcacagagaaagaaaagggccttggaaatccattggtccagatctttcatttttaataagaagtcaattttacctaaaagttaacctgaaaggctacacgggtgatttccgttctcttctggccagtaattgggctctgcggctcctcgcgattttaccagttcccatccgtttagcaaacgcctttagcaaacgcccgtttagcaaacgcctcctccgtcctttggaggagggcggggctaaaagggagatgctgcctagtgattcgttgtggcgcattagtaacgcgactacagggggctggaaacagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaaatgcaattattacatttaaattgttagattaaaatgatatttagtcctgaaaaatattaaattggtcaaaaaaatcacagtgtatgccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaatcggtggctacattctcatcgttttaattaatgaaacttaaatggcttctcttcttccacatgtcctgtccttgacaagatgggcagtatcacaaaaggtcctggcattctaccatctaacactaggaactgtaaaatactgtttaatattcttcttgtttctcttttatctgtgtatctttgccattctattttctcagtgaatagtatgttttctcccattcactgataaattctctcatttgatgatgatacagggtttttaatttttgcaagattctcaatgcaagcattgttatgtatctagaaattatacctagagaaaaatgaaagtcgtttcaaatttgaaatttgcccttttaagagaatgctgaatgtcatcgcagtatataatcactatataaatgtgctgacttacagttattttagtgtctatatgacatattttgaggaaagttggctgacgttatttaaatttaatatatattctatattttagtgttattgaatattttatcactgagcttttttctttaacctgaattccctgttccatttttcattcatattaatttaaataactccagatttctttcttatagtcattattagtagcagatgagattaataattcacatgtttattaaagatagtggcttagaaattttaagatatattgatataggcccgggcgctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgaactgagattgtgccactgcactccagcctgggggacagagtgagactctgtctcaaaaaaaaaaaagaaaaaaaaaggaaaaaggaaaaaaaaaagatatattgatacagataggtagatatgatattgtactttcatgccataagactacacaataaagttcctgaaagttcctggctgggcgcagtggctcacgcctgtaatcccagcactttgggaggccgagg

SEQ ID NO: 464904 - DNA, 1220 bp, Homo sapiens
attcatccgctctgaaaattacgtctttggtggacatcagcgtggacttggatacatgatttctaaatatatatttcccattctataggttgtcttttcactttcttgctaatgtccttggatgatccacaacttttccaaagcagaattaacttttgcagtgataaaagccagagttgtggagagagaagaaggagaagcagaaggagaaagaggagaagaaaaggaaaaattcttggcataaattgttcatcaacaggcgattttcattaaaacaaggctaggatcaactctggaaagcttgataaatccctgataaggtgcccagatgttctaatgaactttgttgggagttttgccatttcaagtttatgcgttttgcccaaaggccaatgattgggatggcctcagcatctgatactgattcttcaaaaagcgccccctccttgccctgggacattgagtgcctgctggagaggttgcaaattggatcagcctaacagaaactgcagtcaggcctggaagcaatattcaggctcacttttccaggaatagtgttccaagaaagaaaggattcttgggatcttttcactgcctgacagtgatgagtatgtttttccggacagagtgcaggctgccttctaagacccccaaaacattttcaagtctgcttcttgaaggcccgaacacagaagattcactcaaaaaccaatttatccacagttctttggttgatctcaagcagtctctctcctggaggaacttactgtcctatagagacatgtgccaactgtcgaagaccgtgacgtggccaaagcacaataagactgttatctttctaaggctccgagagcctcagcctaaagctcccatgggagcacacaccgcaaaggaggagctgagtcaaccaggggagcgaacagccggcagggaggacacgcacacggatcagccccggctgcacacaccacaccgtgcactggggagctggccatgtcccctccttactggcctggaacctctcactcttcagggccaaacatgcccaggacagctgccacctctgggcactgtgggccagcgcagggcctggggcctccttggcatttgctgaatttaatcgagaagaaaacaaaggatatattcctcaaagtagaatttccaggtgaaaggggatgcagatttttaaagcttcaaatagtcataccaaatacagttcc

SEQ ID NO: 464905 - DNA, 1245 bp, Homo sapiens
ttgagacagtcccagcctggagtgtggcagcacaaccttggctcactgcaacctatgcctcctgggttcaaacgattctcctgcctcagcctcccaagtagctgggactacaggttgtcttttcactttcttgctaatgtccttggatgatccacaacttttccaaagcagaattaacttttgcagtgataaaagccagagttgtggagagagaagaaggagaagcagaaggagaaagaggagaagaaaaggaaaaattcttggcataaattgttcatcaacaggcgattttcattaaaacaaggctaggatcaactctggaaagcttgataaatccctgataaggtgcccagatgttctaatgaactttgttgggagttttgccatttcaagtttatgcgttttgcccaaaggccaatgattgggatggcctcagcatctgatactgattcttcaaaaagcgccccctccttgccctgggacattgagtgcctgctggagaggttgcaaattggatcagcctaacagaaactgcagtcaggcctggaagcaatattcaggctcacttttccaggaatagtgttccaagaaagaaaggattcttgggatcttttcactgcctgacagtgatgagtatgtttttccggacagagtgcaggctgccttctaagacccccaaaacattttcaagtctgcttcttgaaggcccgaacacagaagattcactcaaaaaccaatttatccacagttctttggttgatctcaagcagtctctctcctggaggaacttactgtcctatagagacatgtgccaactgtcgaagaccgtgacgtggccaaagcacaataagactgttatctttctaaggctccgagagcctcagcctaaagctcccatgggagcacacaccgcaaaggaggagctgagtcaaccaggggagcgaacagccggcagggaggacacgcacacggatcagccccggctgcacacaccacaccgtgcactggggagctggccatgtcccctccttactggcctggaacctctcactcttcagggccaaacatgcccaggacagctgccacctctgggcactgtgggccagcgcagggcctggggcctccttggcatttgctgaatttaatcgagaagaaaacaaaggatatattcctcaaagtagaatttccaggtgaaaggggatgcagatttttaaagcttcaaatagtcataccaaatacagttcc

SEQ ID NO: 464906 - DNA, 304 bp, Homo sapiens
gggccggtacctatatcgcaagggcagatcttggacaacatcctgttttgctggcattgagaaacacagccactattccaccaatatcatctctaaagaaatgcattgtgcaagtcataaggtacatctaaatattaaatataggtggtatgtacaaattattaagctctattaaagtgataaagtggcatttcaaacatattggcaacccttaggatactagtagttcagaagctttttgttttcctgagaagcattatctaagattttattaaaatgacatttgcttatggcagcctaagac

SEQ ID NO: 464907 - DNA, 1160 bp, Homo sapiens
aaaatctggaagaggcagttgaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggtaactggaaaatatgccacctggcaaggaaactattgccagccatttgacagccaacatgttttttaaataactaattatccaaaacataatgtgttactacttgtttatagtatttcaattattgtatttttggcagtagttttgttacactgtgatgttttattgaaaaataaaagtgccagtgaaaaag

SEQ ID NO: 464908 - DNA, 1488 bp, Homo sapiens
aaaatctggaagaggcagttgaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggcagtttatccaggattatggtatgaggtactattaccaggtttacagcattttagaaacagtagcaacattggaccagcaggttgtcatccacttgatttctacccttactcagtctctgaaggattcagagcagaaatggggccttggcaggaatatagcacaaagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaacattttctgag

SEQ ID NO: 464909 - DNA, 5825 bp, Homo sapiens
catctgagcaaaccaggatgagttaaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgcttttgtaacgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcagaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggcagtttatccaggattatggtatgaggtactattaccaggtttacagcattttagaaacagtagcaacattggaccagcaggttgtcatccacttgatttctacccttactcagtctctgaaggattcagagcagaaatggggccttggcaggaatatagcacaaagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaacattttctgagagtgttttctgtgtgtgagtattaagcagatacttcatccatagactttttgttgtagtatgacttcctgcctccctgccttgtgactgatttgtcatgtttattttttatttttacaataatagttatgttttaaaatgatactttttcaaagtacctggctaccctatactgtgtttttggtgggggaaaggtgttgggaaatgtgactgtgtatttgtttttcttttttatatgtgtgaggcaagttaacaaagaaaacccttacaaagcacacttaactgtgttaggaatgagactgaatctggctaaaggattatacagctgatatccaaaaagaagtgtaaacatgccaacagggtttatatttaggttccaagagttgccaaattttttttttattcatcctttcttttggagttgtcattaaaaaaaaaatcatatcaggaggaggaaataaaggagactttaagaggagagtaaataaaaatattctagaaaagtaacaatagtagtggtctgagaagtcagctgatccatcttcttgctctttagccagagcttcttataacttagcattttatccaagaaacctgtttagtttcctttaacaacattgtttctcaacttttgaactcttaactcatccagattgttttaccagttggagcttgtccttgactccttttcctattgagcattatttggttgaaagagctccagtcctagttttgggaacccacctgggtctcaaactcagctttgctttatgatcttgagctagttacgtaacctttctcagtctagtttcttcatggagaagaaaagaagaatccctttactatttgacagtgttgttgtgagaatcaatgggataataaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaacttacattgtgcccttgattattgaaaacttcctttttataacagattcactgtttggaagctaaagtaaaaatgagccatgttaccagaagtaataatttctatcttattactgatgtttttatactttgtggtaaaactatggaaagttaggttttcagatgctgtggtagctgaaagagtttgatgtacatgtggttaaagtgtgaagaaaatatgaaggaaaaagtatgaaaagtaccctagtcattacctaattgctattttgtttttaaggatctaagaagtgttattgcattgtacagattattttagaaattcacatctttgctggcttttcctttaacaccaagaatatctgttatcatctgtttggtactgtgttttgtttcctcttttaaagtaaaatattgaagtgatatttaaatgtttgcaagtctcatgaccttcctatagaaattcacattagtataataatttacattacaaatacaatatagcctttaattttgaagagtaaaaatggaaatggaagatgaattactatagtgtagttcacttaaatcgaaaatgtatatttgaatagtttcagtgaaatttggctcatatgaccatagtttaatagaattcttatttctattattgataaccttgaataaaaggatctaattataagttatctaggttttttcccttttagggaagagatgttatgtttttgtactactcttggctatagctgtaaaggatgtgtctgaacctggtaaaactttttaaaattctgagttcagttctgtaatattaatgaatattacattataaagatcacttaggaggggtttaatatatgctgatttgttttatatgaattgttagaaatatatacagaaataagggtagtttcaggctacctttcaggctattattagttgggcaagcttatttttagagcttttccctttcattggttggatgtagggcctgggaatacaaatagattttaatagttttactaggtaaaactgctagagagaaaattcatgtcccaagtagaaaaattaatatagctgaatacttaagtccttgttgaaaagttttctgaaatactggagttcattttcctgccttggtaaggcatttttaaaatttagtttagatggcttaaaccatttaaagaagctgtcttcattgtaaatatcaattgtcaatatcaattttcactgttcagaactgtccaaatactcttaaggtttgtctatactaaattcctattctttttaaaatttacctgttttccttctccctagtcccctttcctgccctttaaatctgaataaccagaagccatatattcaatgttttatgtattttcaatgttttgtgtataacgatatatgaagttagtgaattctgtaagacaaaaagatcgtttttattcacttttgattacaaaaaaaggttacatgaataaaataacaatttcctttaagagagggattcctgaatgattaaactgccaaggaaaaaagagtgaattcttccttttaataaaggtgacctaggtcctgaggaagttaggaaaaaagaaaaactcacattatacttgttaaatttgttttcaaatgtgattattaagttgttgtatttattttttgttat

SEQ ID NO: 464910 - DNA, 1111 bp, Homo sapiens
  misc_feature (1)..(2): n is a, c, g, or t
  misc_feature (5)..(5): n is a, c, g, or t
  misc_feature (7)..(8): n is a, c, g, or t
nntcntnngcccggtacgtcccacccgctttctgcctccgaatttgcctacactggggacctcatctgagcgaatcaagcaggctttgactttgtttcactccgcagagtcgtcaaggtggatccgagccacagtgcgtgtccatttccttccttccttctttatccccctcccacacccccggcccctggtaaccactgactctctgtttcgatgagttccacttttttagattccacatatgatgcacgagggtccccttctctccacaccctcatcaacgactgccttcccgccaacagtgcacgagggtccccttctctccacaccctcaacaacgactgccttcccgccaacagtgcacgagggtccccttctctccacaccctcaacaacgactgccttcccgccaacagtgcacgagggtccccttctctccacaccctcatcaacgactgccttcccgccaacagccctgggctggcgccaatggaggtcagggactttgtggccatggagggaccatgggccaatcccacccccttcgcaagtggtgatgcagacagggagcaacccagaaagcctggcccagagccggcacctgtggcatcgaggccctttctctacagcggctcccatcttaggggccagcagctgtgtctggaactaggggacccaaactaccactgtgcctcaggctggcccctcaggctggcatccacccctcagactcctgcagcccctccctccccttggatttaggcagagacagggtgagatgacgtggggtgcaccccaaggggttgttagaaaacaggtgagaacgtgaagcagccgggggccatgtggcctggggggcatctgctgaaagggaacagagttgccatccaactgcccgctctgagccgggcagtggtgacactgaggggcctcactcccgccccacacgggctggaggggtgtgcaccagggcctcgggtcctcagcccccagcccttcctggcactgctgggagaggtctgtgcccgccggctcctgccacagcttttcccaattcagcggttgccacatactgatgatgtcctactaataatagttcaaagaccaaaga

SEQ ID NO: 464911 - DNA, 3703 bp, Homo sapiens
ctctggcagacctgcacgaccatgaccatgaagaaccttcatgatctttatctttttcatgtggctcaattgcaaatagcagaacttaccaaatcattgttaaatgggggcatgttagcaagctgccatgtaggttttccttattgttacaccatgcttctaattgctttcatttggaaagagagctccccatcagcatcccatcagacttgtcatggaactaaaggagtgtttgagcttctgtccggatggcggagaaccaaagagaacttgcccttcaaagacaggatagcagatgcctattctgatgtgatggtcacctataccatgaccagctccctgtacttcatcacttttggcatgggtgccagcccattcacaaacatagaggctgtgaaggtcttctgtcaaaacatgtgtgtctctattctgttgaactacttctacattttctccttctttggctcctgtctggtctttgctggccaactagagcaaaaccgctaccacagcatcttttgctgtaagatcccttctgcagaatacctggatcgcaaacctgtgtggttccagacagtgatgagtgatgggcatcaacagacgtcccatcatgagacgaacccctaccagcaccacttcattcagcacttcctccgtgaacattataatgaatggattaccaatatatatgtgaagccatttgttgtcatcctctatctcatttatgcctccttctccttcatggggtgcttacagatcagtgacggagccaacatcatcaatctactagccagtgattcgccaagtgtttcctatgccatggttcagcagaaatatttcagcaactatagccctgtgataggattctacgtctatgagcccctagagtactggaacagcagcgtccaggatgacctaagaagactctgtagtggattcactgcagtgtcctgggtggagcagtactaccagttcctgaaagtcagcaacgtcagtgccaataacaaaagtgacttcatcagtgtcctgcaaagctcatttttaaaaaagccagaattccagcattttcgaaatgatatcatcttctccaaggcaggggatgaaagcaatatcattgcttctcgcttgtatctggtggccaggactagcagagacaagcagaaagaaatcacagaagtgttggaaaagctgaggcccctatccctctcaaagagcatccgattcatcgtgttcaacccctcctttgtcttcatggaccattacagcttgtctgtcacagtgcctgttctgattgcaggctttggtgttctcctggtgttaatcctgacttttttcctagtgatccaccctctgggaaacttctggctaattcttagcgtcacctcaattgagctgggcgttctgggcttaatgacattatggaacgtcgacatggattgcatttctatcttgtgccttatctacaccttgaatttcgccattgaccactgtgcaccactgcttttcacatttgtattagcaactgagcacacccgaacacaatgtataaaaagctccttgcaagaccatgggacagccattttgcaaaatgttacttcttttcttattggggtacattgacgtttatgtggagggagctgtccatttgaagataggctggcttttccctagaaagtcaaatcaaccttagccaaatttatagattcattaatagccgttctaaatcaacccaagtgtctcagcagtcagtgtgtcattcaactgtgggatgagcaaaataaacagagatgtgagttcattagattatgcatatcatgtcagcagtcatctagacttttgctttggatgacttcacaagaaaacacaaaaggcatttgaattaattaccacatggacaaggtttactgtttcatattagaaataaacagttgatatggattttcgttggcttttactgtatttggaagactgatatggctgctttcagtgagctcacccaattgcaaatgagcgctttacacagattatccatacatgagtctaagggtgcacaaaagaaatttattaatggagtaaggtgaatatgataaactcaaatcagattttcttcttatgtctgcccctgaatccaaaattgggggtgcctgctataaaatcaagtatgtttatgaaaaccttccctctcctataattgctggagtattcattcagagctctcacttgctatataatttctaaccaaacactttccagggaatgtacaacaaggaagtacatggacaacactcaaattcaaatgtccatagatggtggaattttaccactctttagcttacaagctcaatcaactgaaacgtttcagaaatgtttgtgtttggggtttgggtttgagatgtgaaacaaatgacatccttaaacatgttattgttagtcttcaaggtacatatgtgtaccttgatatagaactatttatagttacagtttgctaaaaaattattataatgaaattaactttgggaggtagatgttaaagtaccagcttgtaaaaagaatgtttaatgccaatcatttgtatgtttaatacctgtgtgctcaatgtagtgtcatctttactagatgatttacttcacaatgttttcattcctgttccccaaatgaaaataagtagtctattaactaatttacagctcttagttttggatactattgcagagacacaggagcacttttaactcaaacactatggtttaccatagttttgcggtggtatgaaattgagttagcactgcaatgcaatattgaaaaaatcagaatgcaataaagaaatgtagatatcacctgtgactacttcatgtactacccagactcctcatttattgtttgaacccaagggttagttttttatcttgccaaaaggacatgatcaggaagtcagtgtgataccgtcttgctgcagtgcagaagttttaagaagcaagatactttttaatgatgtactatcacaggatagaagttatgccctacatgaaactacgtattcgcagaaactttgtgtcgtcaatgtgcatctgttcttactagtctggagggaaacaaataagatttccagttttctgctgatccaacaccatttcccataggcagcacaatacaccagcacacagttagcagcactttgggacaaaactgttgaaaggaaagaaacagtgattattctgaaaacatgtaaagcaacactgatcataagtaatttttgttaggtgggacaatactatataatatgatttcttgtgtctaaattttctctaaaagattatttgggctgggtccagaaggctccaatttccctaagcaaccttgatcatcaatgttgtcatgcttcagcttttggcagttttgattcattaccaattattaatatcattatttaaatatgaatattgtcccttcccattatgaaaagctattacaaacatatatggatttatataaaggttgatgactatatgcttttttatattagaaaatcatgtgaaaacaaaattaatctgatgaatgctgttaattattttaacttttttattaggtataaaatgttcataaaattattctctctataacttaccaagatttattagcttgtgtaatttttataatcagaggagtctggttttctaattaaagttttgtcaaagaaaatgaa

SEQ ID NO: 464912 - DNA, 1757 bp, Homo sapiens
ccactttctctttgttttaattattttagttagaagtatatttctggggacagatcccaggtctaaaccctagccaaaaccccttgtgttagaggagctcaccctttactgctgatgaaatctccatgatgaagtgctttcctggtgacacccagagatcgtttgctatgtgaatgcttttcttgctcaaatttcaacaaacatgattgccaaaaaagaaaaaaaaaagaagagaaaagagaacagaaaagaagaaaagaaaagaaagaaaggagaagagagagaaagagagaagagaagagaagagaaaagaagaaaagaaaagaaaagaccagaccagacccatagaatcctatgggatctgctgacatgtttgtctgaacttcgtcttccatatcactgtcaagatagtttttctaactcaccactccaaaatctatgaaaagcctccataagcccctagttgccctccaaattataactgcatttggttcacacttttccctcctcctgaagtgactttccttcttattccgcttttaaaaactttatcacctgcaaaattcacttcaaaaagagctccctccatgaaggtttaattactctcttggccctaaaggaatgacatctcctgtttggcctgttcacattgctgcactgcactggtaactcttcaacgaaacccatttttactcttacctcttattgttacttatgtacaggtcttattgcctctctcaacctcaactaaactatttaagagaagtgtactcatctgtttatttcctgctgagtctagtccaatctcttataatttttagaccattaaaaagctatttgctgaagtgaattgagttgaaattggtatagacaagccagtatgtctggtcatcttaatctatatgttattgaacaatgtgccagctggaatctccttttatgtagtgtccttctcagtattctttttcctttcccatggcattttgagtcctactgctaaagtagaaaatttaagaaagcatgttttccatagtgaaagaaacataggtaaaattctgataaaaataaagcattagaactgaacattcaattagtaaatgctaataaatccatggactaaaacaaaagttatcataaaagtagctagcaatgcacaaggacatgtttagataatattatacaatttatgcttattttctttctccagtgctcattctttccaaatgtttgttatctatgctggatcttgatgagaggaagaaaaaaagaaaaatgaataaaccatatcttacaaaatgatttccagactgtaatttgtaacctgaaataaaatatatgtatctatttatattgacttcctagtcaggaaaaaatgataagcaaacagcagcaacaaaagagctgcaaccctttgaccaccgagagtgttatgaaggcttagtgctgccatccagcacccagcagtcagactgtcaaagcatagcatgtaaagtctgagacagcatagcatttctaaatcaataaaacatcaacttgtgtcaaatattgttcagtgtctgcctagttttgattgccctccagtgccttcaaatagctttacaaaaaatattttgtctaggatttataattgctatctgcaggaaggctagtccaatacaagaaacttcatcattactataactagaaagctgactcgtttttcaaaggataagaataagcttttaaaggataactttgccttctgtgttgaaaatata

SEQ ID NO: 464913 - DNA, 1556 bp, Homo sapiens
ggcacgttagagagtgtgctagactaaaagatggctcccaagatttccaaactctggtgagtgcttataaaagactatgaagatatttgaacctgagagagtttctctagctggccttggtgaaacaaacttctgtgttatggagagggcaagggacaacagttgcaaggacctggattctgccaacaacctgaacaagcttggaaaaggatccctggcctttgatgatatcatggcccaccaacaccttgattacaatttcatacgacccaaaaaaaaaagggctcagcatgatttttgtgacctggaggaggaagatgagaaaaaagaaaaggaaaacttcttggcaatgacaacagtggtaattatgacaataacggtgtacaaagtgatggcgctgatgatgctgatgacaaaatacacgtttactaattcatgtcatgctttaaataattcaaggaattataatgctaaaaatgattttccctctctttattgatttagtttattcattttataaaattaagctgtatctgaactgaaatatataaaaggatgttcaccatgaaaatatatttcattacatatgctgtagtatattgtgggtatatacttggggattgagagaacagaaaaaaggccgaggcatcatcctcttctatgactctgaggatcaaaggcattttcttgtatttcttgaacaaagatttgtggaggacctactctgtgcagacattattagacaataaaggaagccaagagtctcaggcccttcgcccttgcttctcagaaaagaacagctaaccattgccaaccagaatgcatagaaactgaactacttctgtgtctgcaattgtcatcttggacaaattacctaaactgcttgggctgagatatgtgaattcagatattgaagcttatttataccttcataattctatgcttccataatgattaaatccaccatagtaataaataaaggccttaaccacatgaagaaatatttggattttaaataatttcattatgtacttcttttacggctagttagcaaggatagacacagcctgtacatatactttctactttacattctcactaatttgaattgttatcccttccacaggcagcaagtaaactaagcaatcactataaaatcaaggtgctttcacacaggtctgatctgtcattgtgggctttctaaatctagtcagatcatattccttctctgtcctgggacagatcccaggtctaaaccctagccaaaaccccttgtgttagaggagctcaccctttactgctgatgaaatctccatgatgaagtgctttcctggtgacacccagagatcgtttgctatgtgaatgcttttcttgctcaaatttcaacaaacatgattgtactaaatcgctaacacctggaatttcaaagacaacagtggaaaggaaatgagacttggaatcaaaagacttcagtttcaatctaaagtccctgaatgtgtaaactattgtgatttttcttagctacagtcctctcacttataaaatgtttactgtcc

SEQ ID NO: 464914 - DNA, 2946 bp, Homo sapiens
ggcacgttagagagtgtgctagactaaaagatggctcccaagatttccaaactctggtgagtgcttataaaagactatgaagatatttgaacctgagagagtttctctagctggccttggtgaaacaaacttctgtgttatggagagggcaagggacaacagttgcaaggacctggattctgccaacaacctgaacaagcttggaaaaggatccctggcctttgatgatatcatggcccaccaacaccttgattacaatttcatacgacccaaaaaaaaaagggctcagcatgatttttgtgacctggaggaggaagatgagaaaaaagaaaaggaaaacttcttggcaatgacaacagtggtaattatgacaataacggtgtacaaagtgatggcgctgatgatgctgatgacaaaatacacgtttactaattcatgtcatgctttaaataattcaaggaattataatgctaaaaatgattttccctctctttattgatttagtttattcattttataaaattaagctgtatctgaactgaaatatataaaaggatgttcaccatgaaaatatatttcattacatatgctgtagtatattgtgggtatatacttggggattgagagaacagaaaaaaggccgaggcatcatcctcttctatgactctgaggatcaaaggcattttcttgtatttcttgaacaaagatttgtggaggacctactctgtgcagacattattagacaataaaggaagccaagagtctcaggcccttcgcccttgcttctcagaaaagaacagctaaccattgccaaccagaatgcatagaaactgaactacttctgtgtctgcaattgtcatcttggacaaattacctaaactgcttgggctgagatatgtgaattcagatattgaagcttatttataccttcataattctatgcttccataatgattaaatccaccatagtaataaataaaggccttaaccacatgaagaaatatttggattttaaataatttcattatgtacttcttttacggctagttagcaaggatagacacagcctgtacatatactttctactttacattctcactaatttgaattgttatcccttccacaggcagcaagtaaactaagcaatcactataaaatcaaggtgctttcacacaggtctgatctgtcattgtgggctttctaaatctagtcagatcatattccttctctgtcctgggacagatcccaggtctaaaccctagccaaaaccccttgtgttagaggagctcaccctttactgctgatgaaatctccatgatgaagtgctttcctggtgacacccagagatcgtttgctatgtgaatgcttttcttgctcaaatttcaacaaacatgattgccaaaaaagaaaaaaaaaagaagagaaaagagaacagaaaagaagaaaagaaaagaaagaaaggagaagagagagaaagagagaagagaagagaagagaaaagaagaaaagaaaagaaaagaccagaccagacccatagaatcctatgggatctgctgacatgtttgtctgaacttcgtcttccatatcactgtcaagatagtttttctaactcaccactccaaaatctatgaaaagcctccataagcccctagttgccctccaaattataactgcatttggttcacacttttccctcctcctgaagtgactttccttcttattccgcttttaaaaactttatcacctgcaaaattcacttcaaaaagagctccctccatgaaggtttaattactctcttggccctaaaggaatgacatctcctgtttggcctgttcacattgctgcactgcactggtaactcttcaacgaaacccatttttactcttacctcttattgttacttatgtacaggtcttattgcctctctcaacctcaactaaactatttaagagaagtgtactcatctgtttatttcctgctgagtctagtccaatctcttataatttttagaccattaaaaagctatttgctgaagtgaattgagttgaaattggtatagacaagccagtatgtctggtcatcttaatctatatgttattgaacaatgtgccagctggaatctccttttatgtagtgtccttctcagtattctttttcctttcccatggcattttgagtcctactgctaaagtagaaaatttaagaaagcatgttttccatagtgaaagaaacataggtaaaattctgataaaaataaagcattagaactgaacattcaattagtaaatgctaataaatccatggactaaaacaaaagttatcataaaagtagctagcaatgcacaaggacatgtttagataatattatacaatttatgcttattttctttctccagtgctcattctttccaaatgtttgttatctatgctggatcttgatgagaggaagaaaaaaagaaaaatgaataaaccatatcttacaaaatgatttccagactgtaatttgtaacctgaaataaaatatatgtatctatttatattgacttcctagtcaggaaaaaatgataagcaaacagcagcaacaaaagagctgcaaccctttgaccaccgagagtgttatgaaggcttagtgctgccatccagcacccagcagtcagactgtcaaagcatagcatgtaaagtctgagacagcatagcatttctaaatcaataaaacatcaacttgtgtcaaatattgttcagtgtctgcctagttttgattgccctccagtgccttcaaatagctttacaaaaaatattttgtctaggatttataattgctatctgcaggaaggctagtccaatacaagaaacttcatcattactataactagaaagctgactcgtttttcaaaggataagaataagcttttaaaggataactttgccttctgtgttgaaaatata

SEQ ID NO: 464915 - DNA, 537 bp, Homo sapiens
gctactggagcaagcctttgatctgccatattgaactcctccagctgtgcggattcactgcactataagaaaaacatttctacgaccactttaaagctaaactcatttcaggtttgtgctgaagagagattgagaaaaggctaaaaggctagcccaggcttccattttgagacagcaagagtacccagcaatatgacggacgtaactagtggcaagcaggattgtgtgggttttttctttgaagatcttctgtagtaaaacagaatggaacttgtctatttatgacatttttcaatttttctgggcagtcaatgaaacataacattaccaacatcattttctctcacctgatctaagagatttttctttttgtcattttttaatacttcacccgttacaaaagtttttccacctcttacattttgcagttactaatattaggaaatgcaatgccaatttgtttgcaagccatgtaaaaggaacatcttaacaggatagcaaatgattaaatacatggtatattgtgtggcatatatt

SEQ ID NO: 464916 - DNA, 1095 bp, Homo sapiens
gccgctattggggatgtgctggtgaagatggtggtctttggagaagaagtagatctggcctatcaggaagccatgctcaatatggctaccatcaacagaactgctgctggattaatgcacaaatttaatgcccatgtggccacagatatcacaggctttggcattctaggacactctcagaacctcgtgaagcaacaaagaaatgatgtgtcctttgtcatttgcaatctgccagtcattgccaagatggctgccatcagcaaggccagggggcaggtcatggaagttgggaagtccaaaatcaaggtgctggctgattcagttcctcatgaggaccttcatcctgaaatatgggtgaaggagccttcagatgattctagtgaccaagactttgagcagccccagctgatgctgagtggagcagagacaaaccagccccagtgggctctgaccaaatcgcagattcacaatgctcaatctcattgactagctgttatgccacagatagaaatttccactctgtattaacttctcttgtgaaatggcatctggaacacggattacaacaatccatttaactactatgaaacggttctggagtgacactgttgtgaagaggaaattccagcggagctactggagcaagcctttgatctgccatattgaactcctccagctgtgcggattcactgcactataagaaaaacatttctacgaccactttaaagctaaactcatttcaggctgtacaagcatggcaaccgtatctgctcagctcctggtgaggcctcaagaagcttttcatcatggtggaagatgaaaggggagcaggcatgtcatatggattgctttaaatttagcaacatcatctcactggcaatacatgagttgtatttcttgaatacaggaagctacattcacttcagtgaaggcttgacgtcatcaggcagcattagcatcacctgggacttttcaagcctcacctcagacctactaaatccgagtctgcattttaagaagctccccaggtgattaatccccacaataaagtttcagaagcattgatttaaaggatccacgtgtcctgttgtgtcc

SEQ ID NO: 464917 - DNA, 983 bp, Homo sapiens
gagttacttctggtcctgtgtgtggggctgaagcttcagctgccaccagacatccctgccatgtccctcttgagagtcctaacctcactctcaagactcaccccgatgctctccatgaaaataaaacgcaccttccatgaagtgtccccagaaagctccacgggggaggaagtgccacttagaaatgagaaccaatcccagatggaacgaagtctgtttgtggaaacacccttcccctctgtttacttggacctgattttgaaagtaacaagtcactttatttgggctggaggaaaaagcactaaaccagatgttgagaggcactgccgaatgtctaagaagcaacctcattgtattcccaagacctgggaatccaggtctcgcagatacgatgatacaatctatagccaggacatctcttcatgtgtagttttcaatgaatactaggataagcaactatcccagtcttcccaggattgaggggcttctccagatgctgcacttctggtgctaaaaatgagaaactgaaatgaattagtcacccaaggaatgctgaccctgtgctatatgatcacatttactctttaaagcaatgctttgagacatgaaagccagatagggaagaatttgcagcctcatactgattggccagttgaggagtcaactcatctctcttatagaaaaaagaagattacatttacggaatacagaatatactgtgctctctacttaccaagagatttctttctctactgacaactttctgttgacgtggttactgtgcaggttctgacagtcgattctttccacctagttcactgctgaagctataatgatttccattttgcaaaaagaggatgattacttattatctgtgaccatttctcaattccagaacaattgagctgcatagtccctgcaatcttataaaggcatttggcctggaagatgctctgcagccatgtgccaagaataacggctat

SEQ ID NO: 464918 - DNA, 651 bp, Homo sapiens
ggatgctgagggtagctccctatggacctgcagacgcccctccacaagaacagcctgagcgccttggacaacatgattgatgatggtgggaggcagacaggctcctgggcagaaaggggaggagctgtaccctgcagagccacaggggaggagcttctcaaggccttggcagactacctcttgcatcgatgtgccctggatgatgccttgggtctcatgtcccactgcattgtcatcttgaagatttgtcacactttgagagaaaaacttgttgccatgacaatgggctcagaggctgaaaagaagacttcaaccactgtcagcagcatcattgtggtggccaagtggatcatccccagagtagatgatgttgtgaaatcagtgtaccatctgttaagcaccaagctcctggatgctccatcagcagagagcagagaagagaagcaactggatatccaagagaagcagcttgacttcaaagagacaacttgacaacgtggcttcagagaggagtctggccaaggactgctgaactccaggggaggattgccctcccactccatctgctttccagctcccctccccacagagagccattttcatcagcaataaaatcctccacattcaccaccctccaattcgttagtaaga

SEQ ID NO: 464919 - DNA, 597 bp, Homo sapiens
ggatgctgagggtagctccctatggacctgcagacgcccctccacaagaacagcctgagcgccttggacaacatgattgatgatggtgggaggcagacaggctcctgggcagaaaggggaggagctgtaccctgcagagccacaggggaggagcttctcaaggccttggcagactacctcttgcatcgatgtgccctggatgatgccttgggtctcatgtcccactgcattgtcatcttgaagatttgtcacactttgagagaaaaacttgttgccatgacaatgggctcagaggctgaaaagaagacttcaaccactgtcagcagcatcattgtggtggccaagtggatcatccccagagtagatgatgttgtgaaatcagtgtaccatctgttaagcaccaagctcctggatatgaaactgtagttgccctatgttaaaaacaggaaagcagaagtaaatggatcctagacattgaattgcctgccccaaatgaatcctcgaatttacgttaagatcacattttggaattaatcttaacaagactaagagtttgtagtattactaatataaataacatcgaattttcagacagtt

SEQ ID NO: 464920 - DNA, 2450 bp, Homo sapiens
ggaggctgcaggcgccatgggcagagtgaggaaccgcgccactgctcagcggcggaggcgaaagcggcccggggatcctcccgccgcctgcgcggccatcgcggtcacgggcgccagccgcgcgcagtgcccccgggtccaagtcggggtcgggagccacgcggcggccaagaggtggctgggtaggtggcgacggaagcgccgctggcggcgggtccggaaggcgggccccagagacctgctgccctccgcgccaaccccgtacccgccggggcccgccccgtcccccaaggatctggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggcggcctggcggccctgcggggagcgtccgagtacctgcacagatcccatgctgtgaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaaactatgtgtgttggtgtgtctataaagtccggcttggctatgtatggcaaggcttggtttttgaaggtacttggtctcagattatttcagaaggtggtggtgactctggcttttgtagtagagaaagcttccccagggtcccctaccttttgatgaggggaattagcagagggtttacacatttggcctctggggacacactacctgtgtttgaatcctggacctgccgcctgctcgctgtataaccggtatcgagtagattaaaccccattcctcaacttgctctttcctcaagaatgttaacagctaacagagtgtttgttcttggggtaaacacagtgccttgccttgactacctgatccatgaatgcttgttttctcaatttcaggcccccaaaactcctcctatcaaggcacccagacaatatgaaaccgcattgtttaggggcgtccatacacatgggaaaaccatgaattaggcagtgaaataatttaagccagcatcagattagggtttaactctatggaggaggaatggctttgagtgggggtggggggaggggagggtgtcctgcattcctgttcctcttgctgtgtaacaaacagccccacagctccaagcggcacttttccatatccaaggtgaatgttgcatcacctctcataggcaagactcagaagtcatgttgagtcaactgtgtcatactctattgattagagaaatctttaacttcctgctagttgcatatgctggactgcctcagccccacgccactgactgtcccttcccctctcctttttaagccc

SEQ ID NO: 464921 - DNA, 578 bp, Homo sapiens
taaaaatgttaattatacattttaatgtacgctatcaaaatatctcatgtaacccataaatatatacacctactatacacccataaaaaataaaaagtgataaaaccacagaaaaaaatgtcagttcaatcaaaacaaagttgattatcactctcaatcaaggttcgcatctggaagatcgagaactgcacgtcagagttctcttggaaaagctctaggaatcctgggcttccaacgagttgaaggaacataggatgaaaccatggaagtcttcctcagatctggggagggagcctggcccaagagcccgtggagctaatgaaaacaggtagtaggggacgctctacagtagtcctctcagttattcaattagaggtcccaattttgaacgatataactgggatttcaataccctgagtgatttagacacatcagaaaaaaatacgacagaaaactatagtttctttacagccttagaaaaggaaaacgcgtaatttctaactccaggaggacagtattcgagtacgtgggtttctttcacccccgacgtgcacttcaacttttaaaatgcttgctct

SEQ ID NO: 464922 - DNA, 4768 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464923 - DNA, 4717 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtggacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464924 - DNA, 4687 bp, Homo sapiens
taaaaatgttaattatacattttaatgtacgctatcaaaatatctcatgtaacccataaatatatacacctactatacacccataaaaaataaaaagtgataaaaccacagaaaaaaatgtcagttcaatcaaaacaaagttgattatcactctcaatcaaggttcgcatctggaagatcgagaactgcacgtcagagttctcttggaaaagctctaggaatcctgggcttccaacgagttgaaggaacataggatgaaaccatggaagtcttcctcagatctggggagggagcctggcccaagagcccgtggagctaatgaaaacagaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464925 - DNA, 4720 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464926 - DNA, 4761 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtccagtgttaccgagtacaaatctgttgccatgaattactttgtcactaaaagttgctgttggctttttagtgctaggctaagtggggacgggttgaagtcatggccaaaaaaaaaatggcggccaaattaacttgggggcagaaaggagcaacggaggggtccaaggggggacaagggt

SEQ ID NO: 464927 - DNA, 3897 bp, Homo sapiens
cggctgcgcagatgatgggtcggcttatttcattccttttcttttaccactttactttcagagacttcagcgtccatgtctagcggtgctgtggaacccagagtgctcttgcctggataggctgagaatcccttggagcctggaaccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464928 - DNA, 3312 bp, Homo sapiens
atgcgtactagctacatcaagtcttaaaaacaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464929 - DNA, 2354 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatctgtcatatcaaccaggttcagtggtacacttatttcctaattatgaagtggtgctgcagggtaaccggcggttgagcccggaaaaataaaaggaacatgtggccttcagtgcagaaaccccttgaggggggggaaacgggaacaaaaaaaagggggccgcgctctctttttcctggtcttcctctcactcttcttttcctctcgctctaaaaagaaaacaccc

SEQ ID NO: 464930 - DNA, 1357 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaaggtaccatttttagcatttcttcagtattagtttcatgtggtgatgtgtttttagatgcaggcggtacatgtgcaggcttgttacatgggtatattgtgtgatgctaaagtttggacttctaatgatcctctcatccaacaattctcaattgtgtaaacatcatacccaataggtagctttcaacccttgtccccatccctcccctattatattgttttaataataaataaaaaataccttgaatctgaaaacttgtctgaagtaactaaaagaaaaaacaaagaataaaattaattatatattattaaattagtatgtgataaagaaaatgtgtcttggcttagtatctattgagatgtatctttcagcttctactgctatgtgccagcaactgccagctgaggaacaaatgtgggtatgtgagcaattcccgctctttaagtattcatttaatgaaggagacacatgtaagcaagaagaggtaacatgtccaatgtcacggggttggacagtctaggtaataaaagaagtgtcttatgtttggaatattgggtatgtatgaaattgaatatcaggaaaagaagctgaggtgctacattaaaatacgattgtgcctttttaagtttattctctatgggtttggaatgtgtttctttttttaatatata

SEQ ID NO: 464931 - DNA, 423 bp, Homo sapiens
gcgactactactactactaaaattagcggccgctcgatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464932 - DNA, 2149 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtaccctgcttgcaacttaattctcaatcttaattgaggtggggttgttt

SEQ ID NO: 464933 - DNA, 2384 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctggga

SEQ ID NO: 464934 - DNA, 4562 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtggtgagaagcatggggaccgacacagggatgaggggttactggggccgcggcttgcggcctgcagaccccggaagcggcgcagaggatcccgcctcctattccttctcatcctatcgcgcgccacaccctttgccctcctttgcttctactgctatgtgccagcaactgccagctgaggaacaaatgtggagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464935 - DNA, 4714 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaactattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464936 - DNA, 4715 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464937 - DNA, 4446 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464938 - DNA, 3366 bp, Homo sapiens
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataagatctcttggtaacaattgacattgcactagaatttgaatgatactgttgttggcatttctgtttctctttcaagtagttgtaaataatctctttttctcatataaacggaatgcataatgtcttactcttgagtcatttagtagcattgatatggtaccaagttgtatagcagagtaacaaaatcatgatttgacaatgaaatttacatattgcctcacctagagatgttttgtctgtatgacttttttttttttaagtttgtcttactgttactttaaatgttttgggtaaattgtgtaatatgaaaagttcaataaaatgtcgaaataaaaaaaaaactg

SEQ ID NO: 464939 - DNA, 3336 bp, Homo sapiens
gtgggggtgcgcgccagtacgagagtggggaggacagcattactcccttgacatccctcaaagctgttgcatgtatcgatagtttgttcctttttattgcacagtagcattccatagtatggatgaatcacagctttttagtcatttacccattgaagggcatttaggttgtttccagtttgggctatttatgaacaaagatgctagatgctacaatcatttatgtacaagtttttgtatgagcatgagttttcatttccctgagataattgtctgagagtgcaattgctgggtcaaaagataagtgtatttttagttttataaaaaatctgagtaatccagtttgtctgcattgtcatttggtggtgtcaatattttttatttttatcttagctattctgataagtatgtagtgatatctcattatggttttaatttgtatttccttaatggttagtgaagtttaacattttcatgtgcttattattagccatagtgtatcttctttagtggcatctcctttcctatcttttgcccattttctaattgaattgtttaggtttttactgttgaattgtacacattctagtcttttgttggatatgtgatttgcaaatattttctcccggactgtagtttgtcttttcatccagttaacagagttgcagagcaaaaggttttaattttgatgtggttcaatttatcagtttctccttttatgaattgtgcttttgtgattttaagagctatagtgccttctcagcctgaatccaaagtgattcctgtagtaaaggaaatgcagctctttcttcactactattgccatatgtttaaaggaaaagaattactcctatgtgacccagttcacaccttgccaaatccttttactcagcctatggcagttctcaataattttatgagatatagtattgactatatcaagttgaagaaaggccacagatctccatgtaagaatttactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgtagagttactgatggtcctgtgctgtcagcctcctgaacccccttcagatgctcttatgatagaaatagatggaggagagagctggtcgttcatggggctatcaacgtggcccagtgcaatcacaagggaccttaaaagtgaaagagggaggcaggagagagcacgtgagactactcaggcagcgttgctggctctgcgggtgaaagcagggccttggctgaagcttcctgcagacgcagaactggctagatatgctgatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagaggtgaggaaaacaaagcgctgaaactttcagttacattgtgggttgtgtaaacttgatcatctatcagaaaaactacctatcatatatatcactttttctctgggaaaatgtattctttataatataagacaattgtgtttttttcaattgtgttatctttgctgcaactgtctgcaccaaggactctcgtagaataattgaagcaatcccacacatgtaattattttactgtcatttttaacccagaagaaatctttaatggtaaaatagtacttctctttcacttcttat

SEQ ID NO: 464940 - DNA, 2931 bp, Homo sapiens
gggtcatcgggtcttctcatggaaagggtcagtaactcgcgggtattgccatggcgatggaacgtttcttggtctccacgaaaagcagcttaagtgcttcacactcccagagagagggaaagagacatggtagtggggcggctaccccattaaagaatgtcagatcatctactccaagccttcaagttagagacaagcaaaaggagacccagcaagttatagtcgcacagggagttacagccatacaggccatttcagttgcacagatagtttcagtcacacaggcaattacagcttcaaagatcatttcagccacacaggtcatttcatttgcacagcacgcttcagtcacagagctagtttcagtcacacagggtgtttcagccacacaggtagttacaatctcacaggacatttcaaccacacaggtagttacagtctcacaggttgttcagtcacacaggtagttacagtctcacagggttgtttagtcacacagaatgaagccatggtggccatggttgaccagaacgcgtggccttgtctgtacaagctccatttcttcatgtgtccccatcacattacacttagtgtcagtgtttcaggcaccttcatgcttttccaaaagtgtttcataccatttctcaaatgttttcagtttggccatatcccaaatgtatttttgccaaatttcttcctcttcaatctgtctacatttcaaagaaaatttgagccatctgtttctgtttcattggcttcattgttcaaaattctctgtggtagaaactaagtgcaagaagtctttcaaatctctacttaagccttccacacctttctctgaagcacttcataaccaaagggtctgtggaattaagttcttattagaacatctcattttaactcaatgccttccctgtttctactgggatcgcacacctgctcaccagtgaaatgttaactgggagatgagtctgggggagccagggcccttatagcatgagtggatcactcacccagattaccctcctctccctccatgcctaacctgctctctgtgtgcttagggcatgtactccaggagaacacagacagcatctcttctctatatacttctctgcgttggaataaatgcaataaaataggtgccatttatgttgttatactaaaaattaaaagcagaagaatacaatgaaactgcaattctcattttaagcaaaataagcatacatctaaaatgagaagtagtttgtttcatactaaatcacatttattaagaatagaaggaacttggaatcaaattgcgtgtatatttttgtgtcctgaaatcttttcattcaatattgtaccttgggcacttttattaaacctattctttgaaaacatggttttatggctatattgcatttaattttacaattatcttttaaactctttccaattttttatatttataaatcatgctctgtctcagaggacttgagtaatttatttaacagctcccttagaagttgggcattttggttcttacacattttccctactacaaataacaattgattcttaatggcattaattttaaaacacattaattttactcagtgagagggtataaaataactaagaatccatttcctgagcctctctaacatactagaggaaaaattaagagagaaataataatttccatttaaaaagacaactggaaattttcaaccaaaagattaatcacagtgattagccaaagaattaaatcatgtgaagaaaaaaatttaaaaaatcttcattgaataatgcatttcaaggtggagctagaaacagatgctgggaatcatagacgcatgatccagaagggcttgtgagcatgagagcactggacaaataacgtccaggaaagtcacagaggaaaagtaacaactcataaaccagtacagcggaactgaattcaaaaagcaaataataataataaatcacaattgtttataaaatgtgtatttgatgagaaagataaaaataatggtgaaaaatgacaaagtaatgagagaccatagaacaggacttaacaagagggagaatgtgaactaccatgtgtggataattctggatgtacaattcagattccgatgacatgtatcctgaaacctagaggttgacaagattgccaaacattttaagcattaagaacattccgcctttcccagttactacttccaggattacaaacagaattgcttcaggatgctcaggaacatcgtacccttcccattaatgggatgcactctgttttgaaagcagttggaataatggagcaaaaacaaacagctaatgaaaaataaatttaaataaaaccttttacacagaaaacaaaacactagaagaaattttactactttactggaatattacgcaaataatctgtttattaaacaaactctcattggtgtccaaagaagaaacaaaacaaattaagtatcacaagcaagagcataagagggaatgccaatgaattttaggaaaatgactcgataactgcaacggtgatgtcatgtgtgtgtctactttagagagcagatggtcgatctggtgctaatttgcccaatacggtagctacgcggcaatgaaattccaaaactggcacaaggcgggcctggttccagggatcactggatctaaaagaaaaaatccaatgaatgatgcatcccactggcattccaaagagcaagtaaacaaaagaaattatgggtttgggctcagaaaccccaacccttgagatttcagaaaacaaaacgactcattggcaagaggcactgtaacgactcaggttcaaatcccacctctgttatttaccaattgcataactttcagcttcagtgtgacctgaccctgagctttccaatccaaaaatagaagtaatgtctatgtcatggagtagtc

SEQ ID NO: 464941 - DNA, 1128 bp, Homo sapiens
  misc_feature (70)..(70): n is a, c, g, or t
cattggtccgagagaaattagatttgacctgtgcaggacctcagcagcttggacacagcccactgcagangatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccgatctgggtcaaggaagtttgcctctggtaccaccttgggactaagtgtatacccaactaagtcccttcatctccctggaccctgccttcaatcatccctcctcttgcaggtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacac

SEQ ID NO: 464942 - DNA, 1085 bp, Homo sapiens
cttgctagaactactctttgagttctggatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccgatctgggtcaaggaagtttgcctctggtaccaccttgggactaagtgtatacccaactaagtcccttcatctccctggaccctgccttcaatcatccctcctcttgcaggtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacac

SEQ ID NO: 464943 - DNA, 2548 bp, Homo sapiens
ctgtgtgtgtctgttgctaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccaggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataatttttaaaaacttctgttgcattggctgtttctaattctgtagtaaaggtcaatgatttctcttttgaacttgaatcaatagccatgattgatacgtaacattttcagtgagcataatactctcttggatgtcctggttttgtgcctttaaagaaaaaaaaaagctataagatgcctgatgaaatgctttaggttgtcacccaaatggagttgcagaatatgtcccgaaagccccaaagcctg

SEQ ID NO: 464944 - DNA, 2460 bp, Homo sapiens
gtgcatgaccacgcgcctggtttctgacaagcagttaagaacatctctgagtgtcctcagaaacacttgatgacgtcgtttctcctggcactgggaaacatctacaagtctggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccaggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataatttttaaaaacttctgttgcattggctgtttctaattctgtagtaaaggtcaatgatttctcttttgaacttgaatcaatagccatgattgatacgtaacattttcagtgagcataatactctcttggatgtcctggttttgtgcctttaaagaaaaaaaaaagctataagatgcctgatgaaatgctttaggttgtcacccaaatggagttgcagaatatgtcccgaaagccccaaagcctg

SEQ ID NO: 464945 - DNA, 1219 bp, Homo sapiens
tgcatttcacaccactgaaccgtacattttaaaatgtttaagatggtgaatttacattatgtgtatttaccacaactaaatttttttaagttaaagagacagaagagtattaaagtgattcaaaaaacatcatcaagggcttcttcagccgtctcttctttccaaagccagtatatccacagtttaaggcaggaacggcaaacagattccaattcatggacagtccctgatctctggtcactggcacatcctactgaggattctcaggggcacggaatgcagcgaatcactgcacatctgccctggcattgggaggagggggtggtggcctgcatgccaattttttgccatgcatggtttatggtttacagatggacacactggatgtttcagtggacacaaccagccttcaagaagcatgtggacctagagaaagctctgccacctacatgccagcgcatgttcatgctgagaactgcagggaaaaaagaaatggcttatattgactgactaccatcaatgtgccagagaggtcttcttatctcatcttagaggtgagagaacaagtcaacccgctggtaaatgggccaatcagaaatgaaatcagctcatcaccagttccagtcacttttccattttgaaaagcctcctgcatcattctctgcacatatgcagcagatatagacacccaagcacacccctaaggagacagcccacttggactcaaggacattccctgtggcagctctctgaagacagaattatttctttggcagagaaaagcatgctgttccttaagaggacattagaggagaacaacttttctccctactgaaccctttgcacaaatatcttctagaaggacttgttcctcacccactggcccttgattctgtctcactattgaatgaggcttttccaccaaacagctttaaggatggatgtgtgctctggagagagcaagaaacatgtgagagccggtttgctttctgtgggtcagccaacgtctccgccagtcctatgactgtcatttcactgaggattgatatgcctgaagtcactacaaaaacaaatgatgctctgaagctcattccgcccttgcacaaagaagccaaaaaaatagggctctaatttattttagaattggcataatgagacaaaagagtccactgtgggaaatttttgcttatgcaatgaaatttttactctccagctcttt

SEQ ID NO: 464946 - DNA, 1392 bp, Homo sapiens
  misc_feature (1175)..(1175): n is a, c, g, or t
  misc_feature (1178)..(1178): n is a, c, g, or t
  misc_feature (1180)..(1180): n is a, c, g, or t
cgtaacacattacttacaagtttggatgaggttaaaacaaaatgttaactataaaacaacgtcagtcaggtccttcaggaggtatcccagaagaagacattgttaccataggagatgacagttccatgcacactattgtccctgaagaccttatgggacaggatgtggaggtgaaagacagtgatattgatgatcctgaccctgtaggcaaatgctacgctacgctgaattttgtgaatatcattccatgcttttctttgcagctttaccacggtaaatgtatctctacttcattcattttaaatgctatatattcagtataccgtgacagcagtatcatatactttcagggcactgccaatatttcttcaacaattgccatttccgtatacaccagcccttcacctgccaatgcctccattttttgcctgaaggctttctctggccatcagtgactactcagtctgaacacacaacgggctgaaaataccaaggaattaacgtttctcgggagcagttctcaaccaataacttggataaactggaaaaaaatagacaagcttttctttaactttccctacatcctgtcttccttcccggttggaaagcaagctttctgagttcactaccattgactgaagggacatcctttctatactacggtagaactctgtgttctaggtcatccaggctcagccctgggagactataaaacccctgccccatcctcatttgggctgatgccattttcagcctcagcacgcctgcacccaggcgctcattaaaacagcatgttgctccccactgcctcgtgttgtctgttggcgcgctgtcggggttcgaaccgatacaagaaccttccacctacctggtgctttggcctcatctataagcttttccactgtcctgaaacaagatagagaatctgagcggccagtcatctgccctaagtgctgccgccgaagactgaatgtcctggaaagtttgctgtcacatctccattatgacaaaagcattgtgccgaacagatgaaaaaatgcattgtcaacggaatcttttatgtttgtttgtcttcctttaagcaacattgccttacttgttataaaagataaataaatatttgttcatttcaaaaaaaaaaaaaaaaaaaaaaaaaaaaaatttggggggggccnggngncctagaaaaagtttcctaaaacattgcggggggcgcgcgggcaccccgagtatagtgacacggtcccaacggtcttccaaggaaaccggcccagaacagggctggatttctcccaataaaaaagcgcgcgggaacacgaggtttggaacaatccagaggggttgcgaggcccagagggtctatcaccgaggagtccagcgagcgattcaatc

SEQ ID NO: 464947 - DNA, 263 bp, Homo sapiens
tgcaggccattcagtgttccaggtacctaatgagtcattttcttcttcccagtctaccaagcaggatctcaaagcctcctttatctttctgggtgtatacagagtcattaagctcaaatatgtcctttgccaatggacttgagggttgggtttagttattaacttggtgagtctccacccagctaactattctaggaaatcatttggtgagtcaggcattcttgtattcacattgcagcggccagtcatctgccctaagtgct

SEQ ID NO: 464948 - DNA, 1156 bp, Homo sapiens
cgtaacacattacttacaagtttggatgaggttaaaacaaaatgttaactataaaacaacgtcagtcaggtccttcaggaggtatcccagaagaagacattgttaccataggagatgacagttccatgcacactattgtccctgaagaccttatgggacaggatgtggaggtgaaagacagtgatattgatgatcctgaccctgtaggcaaatgctacgctacgctgaattttgtgaatatcattccatgcttttctttgcagctttaccacggtaaatgtatctctacttcattcattttaaatgctatatattcagtataccgtgacagcagtatcatatactttcagggcactgccaatatttcttcaacaattgccatttccgtatacaccagcccttcacctgccaatgcctccattttttgcctgaaggctttctctggccatcagtgactactcagtctgaacacacaacgggctgaaaataccaaggaattaacgtttctcgggagcagttctcaaccaataacttggataaactggaaaaaaatagacaagcttttctttaactttccctacatcctgtcttccttcccggttggaaagcaagctttctgagttcactaccattgactgaagggacatcctttctatactacggtagaactctgtgttctaggtcatccaggctcagccctgggagactataaaacccctgccccatcctcatttgggctgatgccattttcagcctcagcacgcctgcacccaggcgctcattaaaacagcatgttgctccccactgcctcgtgttgtctgttggcgcgctgtcggggttcgaaccgatacaagaaccttccacctacctggtgctttggcctcatctataagcttttccactgtcctgaaacaagatagagaatctgagcggccagtcatctgccctaagtgctgccgccgaagactgaatgtcctggaaagtttgctgtcacatctccattatgacaaaagcattgtgccgaacagatgaaaaaatgcattgtcaacggaatcttttatgtttgtttgtcttcctttaagcaacattgccttacttgttataaaagataaataaatatttgttcatttcaattctgatgagtctgtgagctgtt

SEQ ID NO: 464949 - DNA, 1887 bp, Homo sapiens
tcagttgaatggctgggagagacacttggctgtttatgagaaatattccattacaatctgacgcaaaattagacttttttgggaccttgcttgtatggatgaaaatgaatttaataactgccaacagttggtttgagtttgaggctgggttccactgtgacttcttgttctttgagccgtgctctggggcaaaactcagctgcagcgtggaaatagtaaggcagaaagaggctgaaatccagaagggtgctggtaagattgaccatggtaatgaagaggatcagcacagtttaccgtgtttgcagtgttcttactccactcccgtctcctttctgatgccaaggctcttctatccatccttgactttttaacaaaggacttccctcattaaactgaagagacaaaggagactcctgagggatttagaaattcaatggaaaaagcaaaaaaaacaaaacaaaaaaactctcagagcacttaacttctctcccaaaggaccagagagcctgccaattccccagcaatgccagagctaagcattttcccagtgtcaacattaaatcccttttttgtttttctcttttaaagtgtgtttacaattgaccattatgggaaagatgatggatgtggcctggccccgtttaaaataataaggctaataatgatacagttgtttcgtgcatacggactctttctgaaagcctgtgagcagaaggaaagggttgaggagcccagtgttttcaacttaagtgtagccagctgccgatcatccccacgacccattgctagctataacacttatgctccggcagacttcggaacctcttggctcctgcatgctcttttggagaaaagagcacagaagttttgaatgaatctccagaccctgtccctgagatagcaaggcttagatggacaagcctggagtggacagcttgcattgtgccccatggggactctgccagagaagcgcatgatccttaagacagagatatggctcagtcctgtattccaggagaaagtagactcaatgtttgctcatgaaatgtccctgcgtccagctctgctggtcgtgtccctggcgaagactccccacctatgtagccagcagcatctgtccttggatacaccatcccggctctagcttttccccagtaatcagctggctttcgctggcaggaggacccaggagataggtaaagtgggttgattcagtccttgctgtggaattcagattagactgggaaaggaaaaaattctcctgaccagggatgcaacagtcaggcagtgagaatgaccttcgtgacaatgagccgagataagcctcttggcatgaaacagctcggcaggcaatgatcagtggtctagggattggctacaagtggcccgacccgacccggggagcaaccgagcaccaggaaactaaccagcatgtgaggaacaaaaaaaatctcccaatatgccgaaaacagcctggtgcacagcaaaacttcgttaacaggcggcctggagctgagtgctgtgaagctgaccagaatgaaattgccctgaaagcaacgggactgggtaaaagaaaccggagtaaaatccacctgcctgctagtgtgcaactaaccactgcgagggatgggagaagggagggtctcggagggccgcagggtggaccgggaggagacaggactcctggtgttctggagaacctgaccgagctgcttcggggatgggggagggaggtgtccagtgccttttgatttacaatcgctgcgccccaagcgatcccataaatttgggggccgttttcaccaaaaccgtgacaagactgcaccccccaccaagtcatttagggagggacatgggggtggagggtggaatctggaactggaattc

SEQ ID NO: 464950 - DNA, 2098 bp, Homo sapiens
  misc_feature (1)..(2): n is a, c, g, or t
  misc_feature (4)..(6): n is a, c, g, or t
  misc_feature (8)..(10): n is a, c, g, or t
nntnnntnnnaggggaagaatgccgttattatgttaattaatctggaattgtcactgagaaagttaaagaaattcgagatcgaatacaacgtagagcaaaggagcttaaaaaacactggaccctggggccttctcagccaatgggtgccctggattctccccttcttaggacctccagcagctataatattgcgactcttctttggaccctgtatctttaacctccttgttaagtttgtctcttccagaatcgaagctgtaaaactactaattgttcttcaaaaggagccccagatgcagtccatgactaagatctaccacagacccctggaccggcctgctagcccatgcaccgatgttaatgatatcgaaagcactcccccaaggaaatttcaactgcacaacccctactatgccccaattcagcaggaagcagttagagcggtcgtcggccaacctccccaacagcacttgggttttcctgttgagaggggggattgagagacaggactagctggatttcctaggctgactaagaatccctaagcctagctgggaagaacttatgccccatttttattatgtaactcaacagaatgactcaaagggtgatatttcaggcagcagaatgagctggggtgggggtttgggatcgggagaggaactacctgggcttgagggtttgtttcagcaaaaatctagaataggccacatcattttgcacttaaccatgatgaggacttttattgcatgtatgaatgtccccagaggctattactcaaaagggctcagctaataaataggagaactaataattatcttttttcagattgctgactgtgtgcaactgccgcaaggggtcaaaagtgcttggtttgcacaacatctccccggcattcttacacgtgtggttatggaatcagggtgcagggaagggtcatggagcagagggaattgcatgtgctcgatctttttcacattggagctgctttctgaaacccggcacggggaaggtgagggtgctggatagtttgggggggccacagagtcctgtgggtgttaaatctcggtccccctctggggacttgtccttgcagggtgctcatccaggccttaaaagttggcagcatcccccaggaactaccctgtgaacaaatccaggctttcggaagcacgtgattctgcagaaatgccacattctcttccacatgggctgtgggctctgagtccccctttgcttcctcggcctatgtacctgctgaagaagacagttgtgtcgtgtacatgcaacctaaggaggtaaccttttacccagcctgagacttcagagggtattcatattggggaccagcagcccgtgatgtttgtcccccagagagggggagagagctgctgcctgcagagtggctgctcctgctttgcacggcccctggcttctgcatccctccatcctccagctgggcacagaggttgccaaaagggccagtaggaggagaaggcttcatggaggacgggggcaagagcgggccgaccatgctggcttcctcgccttgtgtctggctgactgcacaggcctgaggaggctgtgtgtaagttggcaaatgacaggaagagcatgtgcttctaatcacccacccatcttaataacgtcgaacagatacagtgcagaaactattgcacaaccaccagcatttcattacatcagaatccttgccaatttgaaagaggtccttgaatccagggagagttacatctttacgtttttgatcacgatcctcttggaagatacttattagggccatttgttgatgacaatattaagaattagcaaatatcttcttaaatataacaaaaattgaattgtttcattagagaactataaagactgtcttcacgtatcagtgcagacaagaaaacagtggctttacaaaaaagatgttcaagtaggctgcactttgcctctgtgggtgaggcacactgtgggagagacaaggtcccctggaaccagaggtgggaaggacagagctggctgactccctgctctcccgcattctctcctccatgtgttttgaagagggaagcaacatgttgaggtctg

SEQ ID NO: 464951 - DNA, 1043 bp, Homo sapiens
cggtaatgaaggctgcggcaggagacccgcctcttaataaggcagcagccaattaacagagcaaatgtttgaggtgtccccgccgagtgatgggatgtcttgtcttctcccagggccctggggcctgtcagtcagacaggcaggaaaggacacgtccttcagaaaggctctcctctcccccgaccctagcaccaccactgagactctctggttgggagtttctagccccaggaatctcaaagccaaagagcacagctgcgcatctgagaaccaagagaattttggcaggagaaggcgaacctccttcctgagagagtggctctccccaccccttcagatggtacctgggaagcacctgctgagcccaccagggtctgggctctggaatggccaggaggaagtgcaggatgtgggccacaggaagagctgtgactgggagacatttgaaactcaggtgttactgccctgtcacaccagcagtagagtctccatcttatgagtcagagctgagtggaagatgagagccccagactgctcagttgcatttgcctggaatttagtctccacagcctggagctggcagggattagttgtgctggcatcctgacctcccagggaaatattatataccttgactggaagctggggaagagggaaccctgtctccttggcacttccatccagaatgaagcttccttcacatttagctggcaaagagagagggagcaagcagatcatggctcaactcaattccacagagaagagatggtgaactcaggcttgtctctggtaaaatcactgtgtgccctgggcccagaacccctgtgtggacccctttcctcccttcagctccaccagtacaatggacccttgtccagaaagggacttctcgtgaataaatttgcctccataatgaccgaataggagaaagttgcacatctaaccacctgtaattatcaaataaaatcctttgtgcccaggtcagctttaatgtatgaattctggggagacacattcggtccatagcagccagccatgatgtt

SEQ ID NO: 464952 - DNA, 693 bp, Homo sapiens
tgtgtatttcaaagaatgcctctcattatgttttctctagatacctcacaagcaccagataaaataaaatgccttcttacattatttcccattttaatattaaaaaaacaaattatttattcacttaaacatagaatctttataagaatctgccaattgttattagagcacaacagattaattattaatgggagtgaaccagatgctttcgcagaggcattgaggaagagaacaggctcttctactgagttgctaaggaaagaacaactaagaggtggagtctctagatttgcccatctgcatctgtctgatccactccacaggaaggcaagaaaacaggggtcccaggaatcttctgcccttctgcccatgactctgcctgcaccagacgacacttactggtgttcactcaagcacagtgtacgtaaactttttggtgtaaagcatgtgtattagtccgtttccatactgctgataaagacacacctgagactgggtaatttataaagaaaaagaggtataatggattcacagttccactttgctgaagaagcctcacaatcatgatggaaggtgaaaggcatgtcttacatggtggccagcaaaagaaaatgagagccaagtgaaaagggaaaccccttataaaaccatcagatctcaggagacttattcactaccacaagaacagtatgc

SEQ ID NO: 464953 - DNA, 2375 bp, Homo sapiens
  misc_feature (6)..(7): n is a, c, g, or t
  misc_feature (13)..(13): n is a, c, g, or t
agtccnnctatcncagctgcagcagtcctgaaggttgatggagggccatgctattcaaacagcaggcgtggctgagacagaagctcctggtgctgggaagccttgccgttgggagtctcctgtatctagtcgccagagttgggagcttggataggctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaaaataatatgtcatacaacactatgtgttgtgcctggagacacacaatgtctcctgtagattaaaatatgcacttttcctaggcagagctatccaagtcatttttccatgtatatttgtacatacgcagtgtgtgaccaaatataagatcagttctttttctactgaaaatttacgaaaaaaaaaaaattgctgtctgcatagtcgcatcttttaagctatttacaaaagagaagaggtggtggtattgggggaaagtgacttcagctattctcaaagagttagtcttcctttgattcagaatttgtcacccgccattttcatagatttaagccaaaagataaatgtgtgaaaatgtaccaatggctgcgaagcttcaggaagtagaggatccagtgatgcattttttttttcctaagggaaagctggctctttaattcagatgctgaattggtgccatgaaaacagaaaatgctattttcttattatttaaaagaacgtcttatctcataaaattgacattgttccaaagttcttgtggtgattttgcactattgttttctcgtatggaccatggtgtcacttgtagcatgtcaatcacacattggaaagtcaagtccttttacttccatgttgtatgtcaacagagagaaatgtcatgtacataatgtatattgttgtaaatactggtttcacactaagtaattctattttgtaaactgaatatggctatttaatttattgtgaaaattaaatttattgtggtatttaaaaatggaatggattaaaattactctatgtgcaattttttttttttttactcattttgttttacgtgccccctgctggcttccaaaatggaagctgtttacgtgcatatgagagcacttggaaagatgtgcttccctgctggatttctgtaccccagtgaaaatgtatttatgaagtgaggttgagtatattaaaaaagaaaaacctcaaccatctggaaatcaagtataatagccacctcaaagaaccctagtgctgctctgctacaactttgtaacaattaatttactcgcagttgctgctgctcaggaagagagacaaggaatattttaacagaatcaaggcatagaagaatcaccattttatttgaacctctaatcagagtcagaccagtagagaaattaaataagattagaaaactctgtactgaaagctgctgatgcttcaaaaatgaaaacaagatctcacaactctccctgttagttgaaaatatatcaatttgctctgaaaggattcag

SEQ ID NO: 464954 - DNA, 1125 bp, Homo sapiens
catctagtgaacagaggcccagaatgttgctgaacattctgtgggacgacattccctcaacaacaaagaattgtctggctcataatgtcaatagttccaaagttgaaaaaccctgcactaaaacaattatcaccttgtacccctggggacaaaggtgtttcgatcctagaactgaggcaataaatcaaaagcaagcaaaatggaaaactggtgtgttagtttggattaatcatcctcctctaattgagatttctaatcaaactgagaatacacataatcagccagatcaaaatatcggcttcagtagtggtgaagctggcttggagagcatgtcttgggtgcaaatggaaaaagggttttcctacccttcacatctgcatccccccatggcaagtagctggagatctgcaggcctccctccagtggttctctgaactccaggcttcaagctcaagagagatgggaatgcagtagaaagaaacagagagaaatggaccactcaacctattaacctcagttaataggagtctcatggccatcaaactttcaccaacagaagcaccctctcctgccctgggaggagcatgtaaaagggttatcataaagaccccaaagggatatctcaatactatccactctggaagtggaggattcatgcccctatgggaaagagttcccaggtgatattgatgcagctattctgaagaattacacttggagaaccacggctctaacctagcctcttcaattgaagaagcagacacctctggtgcccatgtcacattcccgaaggcccatttaagttctgtatgtgctcaaagtccccttgcctcaagcacatgccatgcatctatctgccctctgttccagagcaccctcacctatgcacagctctgaagtgcaaaggagttaagaccactgggcctcccatgcttcagatgcaccaatctgggaggattctgcatgctttgtatgaggtcccagcattgttgagccccagttgcccacagcagcaagctctataacacactgccagatttgcctttcttcttcccgtctcacccttcctattctcttgcttttatttcctaagatcacctcctaaataaactacttgcatccaag

SEQ ID NO: 464955 - DNA, 2830 bp, Homo sapiens
ttcacagggagagtcccgcggagcaggagggccgtgcgatgatagtgaaaaacaagaaccatctgccaaagggcttcagcgacctgggtccaggtcatgatggagcactgggcgttgcagaggggccatcccagggcttcggtgccaagaactgcctgggcctggttctcagccctcccaagcgcccgtggactcactcccgtgtgacggccatgggttcctgcatctactacttcttctcggctgttgacggctgtcaccctcgtcttcctgggaagcccagtcaccaagcacctccgcagggggatcctgcccccaccaggatcctgcccccacgcggtcctgcccccatgagaccctgcccccatgcggcccagcccccaccaggatcctgcccctgcatcctccgctgggttggcatctgcatttttggtgtcttccagggaaagggcaacatggctgacaaggccaagcctgccaaagctgccaacaggacgccccccaagtccccgggggacccctcgaaggactgggcagccaagaagctgtcgctggagttggaggacatgtgcaccgagtggtgtggacggccgtctcgcggggctgtggtgctggtcagacctcgtgccactactgcgctttcgatgcagaataattcagcatttggcgacttgaagtcggacgagttggagctgctctactcagcctacggagatgagacaggcgtgcagtgtgcgccgaggcaggtgttggccccggggagcccttggctgctgtccagcttcagctgcgccctggtgtgggacccggagccccacatgtgtgtgggtggggagagggccatcccgcagccgtccagatggcagctcaggtcttcccgttgctttcagtcatccacccagatggacacccgctccgggagccagtgttccgtcaccccagaagccatacgcaacaatgaagagctggtcttgccgccccgcatctccagagtgaacggctggtcgttacccctgcactacttccgggtgcgggaggggttcctggaggaccctgcgatggacctggctgtggggtctgggccatggctgcccggtggcaccagtcacctgtcctgggccagactatgtcccccgagcctgcagtgcagcagtgggctgaagggcccctcgagtgtggccagagtgggcaccgaggccgaggaggtgccgagagtgagcgagggctgccagggctgccagcgtgctgtcacctctcaacaccactgcgtggtccttgggctgggccatcccgggcaagtctctggtaaatggacggcatccccggctgcactccccatgcctgcacctcagcgaccccctcgggccccttggccagcagcatgtggctttgcattgtggcggctggagggtgcctgtgctatccggcacctgcagggacccgggcggctctgggaagtgacctcccaggcccagtggctgcagcccctgaccccaagggaggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccagggtgctccgcacggaccccaggtatgaagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgaaggccaagaagatgaccacctttgagtatctcattaatacccgcaaagaagagagttcaaaacatcaagcagtgaggaaagatccatacgtgcaaatggacaaaggatttctccagcaaggagctggcgccctgggctcatctgcacagggagtcaaggccaagagctccctgctgatttacaaatgcccatgtcacttctgcacttcagtaaaccaggacggggattcgaaggcacaggaagcagatgatgccccgagtacatctacacttgggctgcaacaagaaacaacagagcccatgaaaactgacagtgctgaaagtgaagactgagattcgggtaagatacgtggcagtgcaggtcatgttgaaatctacccaagtttggttctctagagagtgaaatatcttctttaaaaaatcaccagtgcaaactcaagggctgggctgcttgtcgtttgtctcttgatgtcaacagtaaccccagaacaggaaccgtgtgtccatctttagaagtagtgcatggcagccgagctgggggatcagtcatttcaagccctagagctgaaagaaaaagagaaaaatcactgccgagtatttggagcaacaggttctccctaaatttgtgtgaggtgggtgaccaaaagtccccaagctgagaatttaatagagagtgattctgaactggtcattcccaggagccaagcataattccttctgagtaacaaaccttcatcctaagcctcaaagatttctcacaaataaaa

SEQ ID NO: 464956 - DNA, 2316 bp, Homo sapiens
cagcacttaggaaggggtgggcactgtgaccccggcacttagtgaggaagaggtgggccctgtgaccccagaacttaggaaggggtggatgctggagccctggcacttagtgaccctgttggagcgtcacctcccagatccataaagcagggatcatgaaaaccaacctcagtcagcagggcccatggggcactcaggtaaggaaggtgtccaccagggcagggaggcatccctcgtgctggctgtctccacgccgccccatccccagcaagctctggtctgtgacatccacctgatgtggcacccgtcagcaggtgctggacacagtgtctctcccttgtctccccagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgaaggccaagaagatgaccacctttgagtatctcattaatacccgcaaagaagagagttcaaaacatcaagcagtgaggaaagatccatacgtgcaaatggacaaaggatttctccagcaaggagctggcgccctgggctcatctgcacagggagtcaaggccaagagctccctgctgatttacaaatgcccatgtcacttctgcacttcagtaaaccaggacggggattcgaaggcacaggaagcagatgatgccccgagtacatctacacttgggctgcaacaagaaacaacagagcccatgaaaactgacagtgctgaaagtgaagactgagattcgggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcatagtactgggaaatgggagcacagtactgagaaatgggagcacagtactgggaaatggtagcacagtactaggaaatgggatcacagtgctgggaaatgggagcacagtaatgggaaatgggagcacagtgctgggaaatgggagcacaaagtactgggaaatgggagcacagagtactggggaataggagcacagtactgggaaatgggagcaaacagcactgggagataggagtatacagcactgggaaatgggagcacggcactgggaaatgggagcacagtactgggaaatgggagcacagtgctaggaaatgagagcacagttttgggaaatgggagcacagtactgggaaatatgagcacagtactgggaaatggaagcacatggcactgggaaataggagtatacagcactgggaaatgggagcacagtactgggaattgggagcacagcactgggaaatgggagcacagtactaggaaatgggagctcacagcactgggaaatgggaacatagtactgggaaatgggagcacagtactgggaaaggggagcccacagtactgggaattgggagcacagtactgggaaatgggagttcacagcactaggaaatgggagcacagtattgggaaatgggagcacaagtactggaaaatgggagctcacagcactgggaaatgggagcatagcattgggaaatgggagcacagtactgggaattgggagcacagcgctgagaaatgggagctcacagtactgggaaatggagcacagtatttggaaatgggagcacagtactgggaaatgggagctcacagcactgggaaatgggacacagtactgggaattgggagcacagtactgggaaatgggagctcacagtactgggaaatgggagctcacagtactgggaaatgggagcacagtattcggaaatgggagcacagtactgggaaatgggagctcacagcactgggaaatggagcatagcattgggaaatgggagcacagtactgggaaatggaagctcacagtcctgggaaatgggagcata

SEQ ID NO: 464957 - DNA, 429 bp, Homo sapiens
gcacccgtcagcaggtgctggacacagtgtctctcccttgtctccccagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgagtatgtcccccaccctaagcccccgatccccccaagcctggttggtcagagctgctcatcttacacctctacttgagtatgtccctaaccctgagccccccacacctggggccagagtctttgtcccccgtgtgcgcatgtgttcagggtcagcctctcccagaagtgagatcatggacaaaaagggcaaatcacaggaagaaattaaatccatgagggcccag

SEQ ID NO: 464958 - DNA, 618 bp, Homo sapiens
cagtcttccctctgtctgtgtctttgttataatctccccttcataaaaggacaccagtcactctggattagggctcactctagtagcctcatctaacatccattacctctttcaagaccctgtctccacatatagtcacattctgaggtactgggtgtcaggatgtcaacctatgaatttggaggaggatatagttcagcccataatacaaggattgggaggaagcgtgctgtgccaccactgagatcctattccatgatccaggcattcttgaagtaccattactcagaactgactagtaatgaacttgaattttgtttaagaataagtttaatgtcaacaaggtctttgttcatcctaagaattttgcttcccttccccccacaggaagcagatgatgccccgagtacatctacacttgggtaagttcgtaagtttaatgggaacgttttatctgtctgtacacttgcctgaactcaaattacctaggaaaatatgttctctatttaacatgttcaaatattctgatgacataagggaaagtagaaatgcttcactgaacatttatagccattcatgtggcttattgcactgatcttacttgaaaaaattatagaa

SEQ ID NO: 464959 - DNA, 1710 bp, Homo sapiens
cccttcgagtgggcccagggctgcagacagcattgtccaaagaagacaccctgactcgatgaatggaacaaactggaaactccagaaacaagcccttctttacatttctggtgtttggcctaaatggaaggtgccaaggaagcagatgatgccccgagtacatctacacttgggctgcaacaagaaacaacagagcccatgaaaactgacagtgctgaaagtgaagactgagattcgggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcatagtactgggaaatgggagcacagtactgagaaatgggagcacagtactgggaaatggtagcacagtactaggaaatgggatcacagtgctgggaaatgggagcacagtaatgggaaatgggagcacagtgctgggaaatgggagcacaaagtactgggaaatgggagcacagagtactggggaataggagcacagtactgggaaatgggagcaaacagcactgggagataggagtatacagcactgggaaatgggagcacggcactgggaaatgggagcacagtactgggaaatgggagcacagtgctaggaaatgagagcacagttttgggaaatgggagcacagtactgggaaatatgagcacagtactgggaaatggaagcacatggcactgggaaataggagtatacagcactgggaaatgggagcacagtactgggaattgggagcacagcactgggaaatgggagcacagtactaggaaatgggagctcacagcactgggaaatgggaacatagtactgggaaatgggagcacagtactgggaaaggggagcccacagtactgggaattgggagcacagtactgggaaatgggagttcacagcactaggaaatgggagcacagtattgggaaatgggagcacaagtactggaaaatgggagctcacagcactgggaaatgggagcatagcattgggaaatgggagcacagtactgggaattgggagcacagcgctgagaaatgggagctcacagtactgggaaatggagcacagtatttggaaatgggagcacagtactgggaaatgggagctcacagcactgggaaatgggacacagtactgggaattgggagcacagtactgggaaatgggagctcacagtactgggaaatgggagctcacagtactgggaaatgggagcacagtattcggaaatgggagcacagtactgggaaatgggagctcacagcactgggaaatggagcatagcattgggaaatgggagcacagtactgggaaatggaagctcacagtcctgggaaatgggagcata

SEQ ID NO: 464960 - DNA, 811 bp, Homo sapiens
cccttcgagtgggcccagggctgcagacagcattgtccaaagaagacaccctgactcgatgaatggaacaaactggaaactccagaaacaagcccttctttacatttctggtgtttggcctaaatggaaggtgccaaggaagcagatgatgccccgagtacatctacacttgggctgcaacaagaaacaacagagcccatgaaaactgacagtgctgaaagtgaagactgagattcgggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcatagtactgggaaatgggagcacagtactgagaaatgggagcacagtactgggaaatggtagcacagtactaggaaatgggatcacagtgctgggaaatgggagcacagtaatgggaaatgggagcacagtgctcgtaccggtatcctcttccgtcctttaca

SEQ ID NO: 464961 - DNA, 772 bp, Homo sapiens
  misc_feature (1)..(2): n is a, c, g, or t
  misc_feature (4)..(4): n is a, c, g, or t
  misc_feature (6)..(6): n is a, c, g, or t
  misc_feature (9)..(9): n is a, c, g, or t
  misc_feature (11)..(11): n is a, c, g, or t
nncngnganantaggtgattggtggaaggaaagacaagagctggaaagtctttgggaatgtgcagttatccattcatgctacctcacgggtcccacgtgcaacttcggggcgttatcatgaaaagtatggtggaaatgtgaagttctgggatacatgtgcagaacattcaggaccctctgctgcaggtctgttggagtttgctggaggtccattccagacgctgtttgcctggctatcactagcagaggctgcagaacagcaaagattgctgcctgttccttcctctggaagcttcgtcccagggggcacccgccagatgccagtgggagctctcctgtatgaagtgtctgtcgacccctcctgggaggtgtctcccagtcaggagaatgaccagaccatgcaggcccttgcaactaaaggatgcagcagttaatatttgtggataggcttaagaattccagctactgacaagaccaggccaaaatatttttgggaaggaagatgtttcaatctccctcaaatctatgttggggtttatttctgctgccaaggtctaaaacagctatgaagttgtgtcttactatttcttccagtggcctgcaatccactggaaaccatttcctctgttgtccagcaagcagtttaattgagtactgcagtactcttcttgaggcagtacaagttggggaataaactcaagtaaggggtcatgtcctgtttagaagaaacaatcattttaagagtaaagaatttgttttgactactcctggg

SEQ ID NO: 464962 - DNA, 2958 bp, Homo sapiens
actccctgaacacgttcaggagctgtgtgcagctggaggcctagcactagttggagagacatttttagacttcacaaatgacatcacatcattatgccaaatactttctttcaacaaggttagctcaaaacaaaactcctatattaaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagggcaaaaactacagtgacagcaaccatcaaagcaacagcaggcatttcacttcggatctgggctacacagcaggagagaacatacctccactctcctccattaaacaatcattaaaatctcatgggaaacttgggttctacacactgcagtctggaaatgctgccctgcgtgcaataataaagcagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggatgctcttcaaagcattgctcatcatttatggaatattggtcattttccgtaggatgatgaagtcccgaatgatggtcattggctttgccattggctatgggtgcccattgatcattgctgtcactacagttgctatcacagagccagagaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggccatggaaagcaggctggagtgaggaggaatggtcatgcttccttggaagactttctcttcttgtcaggagtgactcccaagctcttggtcggccgaagaaaaactgaggataacatttgctgactgggctttaaggagcatgatttatggaccccttaacctacccgtgccctgcaagaggctggcttcttggtcaatcttgactagattaagagtcaatctgcaagccattttatggtctccctggccagctgggggctgtagggccctgctgggcttggtcgtctttcactcctgaggcctgctctgtggctccatagctcagtcctccatcactctgcgtggatcctgggtactttggacagtgagggttcgatccaattttaggggtagggttgggggtgggagtgggagtgtgggttggcaggaggaagaatgagtctactttggagacaattaagtcatggtacgtttcctaaagatagggaacggaagaaaagcaagagaactgtttaatatgctgattattttagtctattttagaccttgagtaaactaatttagcttctaggatccaagtttccttatttgtgaaacaggaaaaaaaaattcttgtaggtattactgtttgtgtgtttgagtttactgcacatgtttgtgtttgtgtatatgtgtcttttaaaaatactatatataaagaagattctggttgttattttagacataaacgaatatatgtacctttcacaacttgcgcatgtgtgagttcattt

SEQ ID NO: 464963 - DNA, 4057 bp, Homo sapiens
gcagcagccagtctagatggcccgccactgccatgactcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaagaacactggggaacatttgaaagtgtgtgcagaagaacgggatcaaagagaaagggtaatcgaagttggaagaagcaggagagctcgaagtcatagaagtgaagatgatgattccacacaacaggatgagtttcgagaaaagttgtgggcaaggagtagatcttggtggtctgagaagggagtgcagcagaggtttaaagcagtgactgacggaatagcaaaggaaactgtacaggaaatatgtattgcaaaacacaatgaaaaaatccaacagcgcactcggattgaagatgaatatagaacccatcacacagtacaactaaagagagaaaaattacatgatgaagaagaaagaaaaagtgcctgggttagccaagagagacagagaacactggatagacttcgaacatttaaacagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgtaaccccagcactctgggaggccaaggcgagccgatcacttgaggtcagcagttcgagaccagcctggccaacatggcgaaaccccatctctactaaaaaatgcaagaattagccgggcatggtggcatgtgcctgtaatcccagctactcaggaggctgaggctggagaattgcttgaacctgggaggcagaggttgcagtgagctgagatcacaccactgcactccagcctgggcaacagagcgagactctatctca

SEQ ID NO: 464964 - DNA, 1935 bp, Homo sapiens
agctcggtaccctttctctgatcgcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgtaaccccagcactctgggaggccaaggcgagccgatcacttgaggtcagcagttcgagaccagcctggccaacatggcgaaaccccatctctactaaaaaatgcaagaattagccgggcatggtggcatgtgcctgtaatcccagctactcaggaggctgaggctggagaattgcttgaacctgggaggcagaggttgcagtgagctgagatcacaccactgcactccagcctgggcaacagagcgagactctatctca

SEQ ID NO: 464965 - DNA, 1896 bp, Homo sapiens
catccccaccgaggatggcacatactaacgcgggggggggggcttttgtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgtaaccccagcactctgggaggccaaggcgagccgatcacttgaggtcagcagttcgagaccagcctggccaacatggcgaaaccccatctctactaaaaaatgcaagaattagccgggcatggtggcatgtgcctgtaatcccagctactcaggaggctgaggctggagaattgcttgaacctgggaggcagaggttgcagtgagctgagatcacaccactgcactccagcctgggcaacagagcgagactctatctca

SEQ ID NO: 464966 - DNA, 4157 bp, Homo sapiens
gcagcagccagtctagatggcccgccactgccatgactcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaagaacactggggaacatttgaaagtgtgtgcagaagaacgggatcaaagagaaagggtaatcgaagttggaagaagcaggagagctcgaagtcatagaagtgaagatgatgattccacacaacaggatgagtttcgagaaaagttgtgggcaaggagtagatcttggtggtctgagaagggagtgcagcagaggtttaaagcagtgactgacggaatagcaaaggaaactgtacaggaaatatgtattgcaaaacacaatgaaaaaatccaacagcgcactcggattgaagatgaatatagaacccatcacacagtacaactaaagagagaaaaattacatgatgaagaagaaagaaaaagtgcctgggttagccaagagagacagagaacactggatagacttcgaacatttaaacagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggctgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaacctgattttgtttgtttaaaatatcagtggtacatattttcacttcatttcaaataggaggaccatagcaagttgtatatctgttatgacaaaagttataacatggagaacaggatccagaga

SEQ ID NO: 464967 - DNA, 1520 bp, Homo sapiens
aatcagtggtgtttactcagacttaaacaaagtagctggacctatgcaccaggacccggaggacaggattttctccaactactattctatgggactgtgtccagcctgcctggattctacaagcagtgttcattgccttattggaacagatgtcattgtaaatgtacccaccgattctgctatcatatggcagcagcattcttcctccactcacatagtttatgtccagccctctgccaatgagaagatatggctggctggatatcaagactgtcagtcattctgcctcatccataaatttcacagcctgggatacagagctcatcaatgccataaggaagttgaggacttagactgtgtcagaggaaatctttttggcatgggtctgaagatggaagctggagctgtacacgggctaactctcatgggctactatcaaacagtgagggaaacccacagtctcagagagaaatgtcttctgtgccatttgcagttaccttgctaatgagatgagtccacagagaagagggagcgtctcggcaggcactccagagctctcaccaaatgaggcactgcctattaagcagcatgaaagtacctaaagactgcccataaaacaggaacaaagaaaacaaagctcagtttcacctccagccaaaaaggagtcttcatgacctatcaatatgtaagatgaatacagatcatgctgactttcctcagagaaaagtctaataaaaaatgtccttatcaatatctgcttgaaatctagtttatatggaaaatggagagcataatacacttcaaaatgctactagtatctactacagtgcttatgtcctataaaatccctatggacaaaaacaattttacctgtgaataaaaattagaaatgaaagaggtaggtgactatcatttgaagataatcccaaaacaacatgttgaataatatgcttgagtccccaaagagctctttaactggacaatgagttccaacatcggtgcaatttccttaagagcagagtttcccagatatttcatgatgtcttcaacctttcaatgccccaactcctgatacagtgccacactcttcagacatttaatattaagaaatagctaatgaagtaaaatgtaaagaagtaatactggagaccaaagggtgaggtgatgctgaagtcagctaggctcttcaaaaatctataccctagtatagaggaaagcacatttgagctggacaggacgttagagattcatctaatccaactctctggttttacaaatgaagaaatagaagcttattttttccactggctcacaaaacactaacatcctgaaaagatgctataaatccacagttaacttacttaattagtcaatgatgtagccaagtggctatattttcagcccttatccctgtgggctgttttataaagtgagccactggtaacagagaagctgaccaaggccctagatgcacctgggggcagactgtcagcaagagaaaaacaatttgaaatgtcaga

SEQ ID NO: 464968 - DNA, 1052 bp, Homo sapiens
tgttcagtgttgctgctgaattctcacaaagaccccttcataatctttgttcacaaacagggagcgtctcggcaggcactccagagctctcaccaaatgaggcactgcctattaagcagcatgaaagtacctaaagactgcccataaaacaggaacaaagaaaacaaagctcagtttcacctccagccaaaaaggagtcttcatgacctatcaatatgtaagatgaatacagatcatgctgactttcctcagagaaaagtctaataaaaaatgtccttatcaatatctgcttgaaatctagtttatatggaaaatggagagcataatacacttcaaaatgctactagtatctactacagtgcttatgtcctataaaatccctatggacaaaaacaattttacctgtgaataaaaattagaaatgaaagaggtaggtgactatcatttgaagataatcccaaaacaacatgttgaataatatgcttgagtccccaaagagctctttaactggacaatgagttccaacatcggtgcaatttccttaagagcagagtttcccagatatttcatgatgtcttcaacctttcaatgccccaactcctgatacagtgccacactcttcagacatttaatattaagaaatagctaatgaagtaaaatgtaaagaagtaatactggagaccaaagggtgaggtgatgctgaagtcagctaggctcttcaaaaatctataccctagtatagaggaaagcacatttgagctggacaggacgttagagattcatctaatccaactctctggttttacaaatgaagaaatagaagcttattttttccactggctcacaaaacactaacatcctgaaaagatgctataaatccacagttaacttacttaattagtcaatgatgtagccaagtggctatattttcagcccttatccctgtgggctgttttataaagtgagccactggtaacagagaagctgaccaaggccctagatgcacctgggggcagactgtcagcaagagaaaaacaatttgaaatgtcaga

SEQ ID NO: 464969 - DNA, 3355 bp, Homo sapiens
tgcctgcagagctccttgagctccacctctgaactccctttcagcagccggcacaggcataacagcccagcccacagaggtgctccctgggactggtcctacttcctctgccacctctgatcccaaggtgactctgccaaaatctgggggatgccagcgcttgtgacggtgtgaccagggaggggaagtgtaagtgtctggccgtccgtggtggcggggccagcaggctgtcccagccctcacccggagctcctcacccggcaccacatctgtgttttcccaggacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccaggaatctggacactgagcccctgaagttggggacaggaaacccagggagctctggttttgttcccaggtcctatcagttcagcttcacccagctcctgccggctcctcgggaggagacaaggcttgaaaaccctgccacccaccctgtgcttgaccagccatgtgggcaggggctccctgcaccaaacaacagcatccagggcaagaaagtggagctggccgcccgcctccaaaagatgcttcaggaccttcacacggagcaggagcggctgcagggggaggcacaagcgtgggccaggcgccaagcggctctggaggctgcagtgcgccaggcctgtgcccctcaggagctggagcggttcagccggttcatggccgacctagagcgcgtgcttggccttctgctgctgctgggcagtcgcctggcgcgcgtgcgccgcgccctggcccgggcggcctcagacagcgaccctgatgagcaggcctccctgctgcagcgactccggctcctgcagcggcaggaggaggacgccaaggagctgaaggagcacgtagcgcggcgcgagcgggccgtgcgggaggtgctggtgcgagcactaccggtggaggagctgcgcgtctattgcgccctgctggcgggcaaggccgccgtcctggcccagcagcgcaacctggacgagcgcatccgcctccttcaggaccaactggacgccatcagggacgaccttggccatcatgccccgtctcccagcccggcgcggcccccagggacctgtcctccaccgccggcacccctgccccatcctccttcctggctgcctgccgcggtgctttcgggcttttgggggagcacaggccgcggctggcatcgttgctgggcaacaggcagccccgcggccgcctccccagctcgcttattccgcccccgctgctcctcctaacatggatttaatcagtgtactttttaccttcaggctgtaaattagaaacggaacagggaagccatgcttcagtttcctcactttaaaatcaagatacaaatagtacataccttataaacttgcgattaatacctgcaaagtgtttcgaattgtgcctggcacttaatcagcacaggttatacagtatatgcattaccctggatctccattaggtaagggagacatgcttaagaataacctccaacctccattaaaggatatgtaaaactttacttaaaagcttgctatggatac

SEQ ID NO: 464970 - DNA, 3262 bp, Homo sapiens
agcccagcaggcccgagcaaaactcggtctttacatcctcggacttctgagggtgggggaaccatgcccccacccccgtggctcccgggccttttcatggccttttccttccttttttgggacccattgctaagcagcagttccttgccctgctggggctgggacgcatggcccaagggtcccacacagctggctggctggttcccaaccacaagccaccgcagccttcccctttcctggccaaagggtttagctttatcggacagaaaactctgacccatttccccaaaacagtgccccctgtcagcaggaagcagttaagatcagtcttcatccttatccttaatctaatggcagttagatgtacttctttagagggggaagtgagacagccaggtgggagggggtcctcagagaaactccaggtcctcggagaaactctagccatcctacccactgaggtggagcctcgggaagttcacgccctttgcagcatggcctgcctggcccctcctcttccttccctggaaaccagggattccaacagcaacctaaattttcatggctgtggaatggagaagaaacctgtctttagccgaactaaggaaagtcctgcaacagtttcatgagtgttttcttcttgtcatttagatcaaactcatcaattcctagaagaatcttgttcattccctagttcaagctgcttctcattcgttgagtctctctctaacacattatcctatttgtgcctgtcatggtacactgtacctaaaatgattgaatagtttctttgataatttagtttcctgccattagaatataagcttattaaagacaagtttactgtttgtcttgttcattcctatatccccatcacccacaacacaacccattccccgtcttgcataccactgccatttagtttatttggttgacagttgccgtgatctctgtattcagttcaggatatgcatcctttggatttatagtggcattctgatcaggaatatcagcatcattcttttctgtggattattcatctgtgaggctctaaatggttttgtttatgtgtttgtttttgttcaaaggtcagctcaatcttatatttaattctgaaaaatatgacatgacaaatgttaattataattattattcacttgtgcttgacaaatactgctttctaaagaaaaattatcattgtgatactatttctttaaaaccccaaaatgtaaccagtggacttctctctagtatactatactaagacttcaatacttctaagctattgttttcgttttttattactcaaactgtttatatatggagactgcttatcagataaattcattctgggctttttgcaattatacttcaactagcattcttaccttaaaaagctaatagtattgtgttttaataaaattgaataaaactcaaatatacccagttttcacaatctttttaaaagagtctattgacagcaatttttagttggaatttttatcagaaatatcctccaaaccaaaagctttggacaaaatatttagtttgatttatttggtcattattgtggctgtaaatgtttgtgtttatgtaaactgtttttgtctacatggtattgaaacatgaattttttttgtctcaactaaaaacaattgtattccaagatatcttgaagtgtcttcacgtgtgtaaaatagtacttcagcattactgtatttacaatgatattaattataggtagatccatcctatgtggtaaaatgaaaaggactctaatatttctggtcttaaactgttatgcagtttcaacaatgaaagtttattatttggggctaattgttttttaattccagggcttaaaatatatgtgattattattaattacgattataaagacaattttattatttaactgtatctaggaaaatgaaggaattgaaaacaaacttcaacttggccaaaatttagcctagagctattgcctgaaaaataagtagaacccatagcaaacaagcattgtgtgaatcatgtagtgttttgttttgcattgccatacctgtcaatcagcctaaactgttgattgtccatgtaaacacataacataataatgttaaacatttttttaaaggcagtccaaaatacagggcatagtgttattggtggaagttactggtgatgaaggagaatgtaaaattgttttaattctctttacatttttcattgctccattttaaatacattttaatagacattcattatatttagaaattaaatgtttgggatatctaaataaacattagttcagttatttttcccttttgtcttttacatctgaaaccttttaggctttgacctagattcagattcagtggcactaatcactaatacttaacaaaaaaacaattaaaatgtgaagtatgctaatgtcttgcttctttgaatattctacccctgaggattatttgtttttaattcccatcactttttaacagcactcctaggaaacatttaacaatagttttaaataaaggtaattttttgaaagaataataaacttagcaagataatttttatattcaaggatatagtcaaatgcattttctaaaagacattttatttattaggcaaaattagagttttacaagtgacataatggtataggctattattctatgacagtttaataaaatattggctaatttaggtatataaagaagattttgctttgtgcattatagactaattgacttaaattattttaaaatattttcttacatttaaatattttcctttaggacatgaatcataagcattcaaattgcctactagaaaattgtgtaatgtcataaataaagtataacagttaaatttttggtggacctattttatctgaatacagtaagttagtatgattgtttcagatatctcaggataagtacaaaatctacattgtgaatacccccaaaggtactcactcagaaacacagtttgtacacttacaaagataacatccttcacaaaagaaaagaaagcagtttgcataaatcttaataatttgaaataaatcatattatatacaacaggaattgaaatgaaattatatgattaagtaaattacctttagcctgtgttctactgagaatacacataacaacaacaaactttaaactcagcccaattcctgaaacgttaatgcaagcaagtataataaaggtttagcagaagaagtatgctttaaacatcaaatgctcagtctcta

SEQ ID NO: 464971 - DNA, 668 bp, Homo sapiens
aaacctattcaggaagagccacatcacaaaataaacttttttattttctaacaaaattaattttaatgtaactatatttaactgtatagattgaccttaaaacaagaagaagaaaagagaaaggatgctgatatgttgtataaaaaaggtagtgaagagttaaaaagaaaagaagaggaatatgggaaagatgttgaaattaaccaacaactgaaacggactctgaaaacacgagccatggaattgaggacagtaagaaagaatttggatcagatttctcttagccataagaaagaaaaaggtctcttgcatgaaaatagcatgttgcaggaagaaattgccatgctaagactggaactggatacaataaaacatcagaatgagataaaggaaaagaaatattttgaggacattgaaagtgtgaaagaagagcatgataatcttctaaaggctataacattgaatgaggaagcattagcaaaaacagtatttcagtacaatggacagcttagcattttgacaactgagaataaaatgctcagttctgaactgaagaatgtaaaacacaacaaggaatgactggaaacagaaattcaatcatttcatgatagactggttgctgctttacatgattgtgaccaaagtcagatagcagaaagagagtcttt

SEQ ID NO: 464972 - DNA, 1384 bp, Homo sapiens
gcctataagccaatctgggcagcagagacttgcttctgaaaggatgggcccctcagttgaatgctttcttctgaggaggcgagagctgaggttgctgcagacccatacaaatttgctgccactaacaggagtgctgttaatgattactctgggacaggaatacatagcgggggcgattgcaggcaaactgacacttaacattcaccccacttccagaatcagcagttactgtacgccagcacctttcactctccaaggagactgctcagctacagcaggaagcacagggatcttaaaacataaactcacagtgctccccacattgatctcccacacaaacccatctctcctgtcagggactgtgggcttcgtgactttctccatgtgctggactgtcgcatggtcactgttgccagggactctttgaactaatcccaagcctatgtcagaaaagcctgtgatcgattcccagtgccatcctgaaccacaagattggaatatcgcacctttcaactgcctgggctgataaacaatacagcatgtactcagcttcataaacactctgccttgttacaaagggcattgcaaactcgccgtgataggacttgaccttaaaagctatagacaatctagcggagcacagacggtttcataaagtacaatcacttcctggaattcttgggccagtgcagtcggagccgtgcaaatcctgttttccttgcattgtttcctgcatgtgaatatcatcagtctagcagtctctctctgtcaccaggctggagtacagtggggcaatctcggctcactgcaacctctgcctcccgggttcaagcgattctcctgcctcagcctcccgagtagctgggactgtaggtgcacgccaccatgagcagttattttttgtctttttagtagagacgaggtttcactatgttggccaggctggtcttgatctcttgacctcgtgatctgctggcctcagccttccaaagtgctgggactatagccgtgagccaccatgccaggcccatctaacttttaatatagattgtatgatgttttcataaaacaagcagggctcagaaaggccgtataaagccacagagccagcaagcagcagagtctgcattttaatccatatgttcatggcttcaaagcaatgttatttaactctaacaatgcaattgaactaacaactgacatcagacacaaatattctgaagaacctggagaaatagaaaagaattggatagaactgatggctcatgggcagaagctgtgcatcaggaagaggaaataaatggcattgttcagccatgaagccatataatttcaacctgactttccttctctattgtcctgtctcattgtctagcttgaaatg

SEQ ID NO: 464973 - DNA, 2023 bp, Homo sapiens
gagtgaaggaagcccaggagccaaggcagggaggcaggtcttttgcccagaaaaacaaccaaagtcccttttactggttaatggcatggcacgaacactggcatgtttacaatggtgtccaggaggatgtaaggtctgactccaccaatagtgacattacagccaaactgttcctgctgaaaaataaattgattagtttcctgtgtggaaccttctatacagtttttcctgcatttttcgaagcctggtcctttagctgccagtcaattctaaaagtctactggcccctggatagagcatctgaatctctgggaactgagatacagaactgtgtttatctcatctttcacgcctctcctagatgccctccttttccagctaaagtttcccagtgtggaggattaatacaagaggaaggcatgcagacagacaggcaaatggctctgaaagatgagagccccatgtcacaccagcagacaggaaccaatgggacacggttcggtggactcctggtttagaatccaagaatgctttttctttactgcctagtttaaggctcagaataaagaaatgtatttgggatgccaaccccagatctgctccctttgtgacgcggtcttgctctgtcacacaggctggaatgctgtggcgcgaacttggctcactgcaacattcacctccggggttcgagcaactctcctgcctcagactcccgagtagctgggattacaggcgcctgccaccatgagtacatgttttataaaggtcaacagagaaggaagagtaggatgatctcactgaatgttttcaaaggctaagctgaggaatagcttgcctcacccacacccattggccagaacccagtcagctggccccaatttaactggaaaaatgtctaggacgtggcattgtttctgttgtgagaaatcaggaaaggcctcccagaagaaggaccggacatgtagaggaagtaccctgccttctcaggaagtatcttgggacaaccaaataaatggaggatttccagctctctaaatccttcagctcccttacaattgccttatttgagctcaggcagtgtttaactaaccagtacagcacatacttaatccattaatttggtttatattttccgtttacttattctaccaaggacaggcatttatggagtatttactatgtgtgagtttcagaacaggctgtatacaaagataatcatggtattgttatttccctcaaggatgtttaatctagttgaaaaaataagacagatatgtagagtattaagtaataacacaataaagacaatgttgaaccacctcaaaggtgtaaacaatagaaaatttattatttcatgtagaaaacagttgaatggtttgaagactgggcaattaggtaatttggtggctcacaaatgccatctaggaccaggttatttccatctttctgctctgctatcctagggtttgctgtagtgtcccattttgtatgtaaacatgactatattcagtggaagaagagagagaagaagtacatttcctttctgtatgtcccttttcaggagtaaggagtccttcccaaaattccccagcagattctcttctttatcatataatgtcaagtccatgcctaaaataatccctggccaaaagatgaatctagtcatattttatttcctgtgactagaactcactttatctgaaagacagaagaacaaaatcaagactctgttacaaggtgttccatgctgggcaggtctatgcaaacctacccccaaagtccaaggaagctgagaggtggaagacagaagctgacatatgcagtttctctgaaagaaacatttaataggaacttaggaagagaagccatgtctgcgtctcaagtggtggtgagaggagatgatggatccctgtgccattactccccaaagccagaacttatatgtcatagggaaggggtatatgtgattcagatgggatgtgtaggacaagtgaggtatgataacatcaaggttgttttaacc

SEQ ID NO: 464974 - DNA, 5160 bp, Homo sapiens
ggttaaggcaggaaccagccattttcacttattttgtggttcttcagttgcctcaggccatctggatatatacgtgcagacttgggctcagaggcctgacaaggattttctcccacggccacatcaacccacctacgcaattgcatctgtgcccgaatacacgctcttcacttctgttactatgggtgaaccatctgtgctctgggccgaggccaacctctctatgtgtacattagatcccaccctctctccaaaagatagggtctggctctgttgccgaggcgggagtgtagtggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagagtatgtgattgacaagtcctaaactttcttctctgagataaagtttcatacaatctttcctgtaccttgtattcaaaacactcttttaaaatctcaaagtgtctgtgtatttcagcatgttttgaggaaacaactcacagttcaaaagaaagtatcgctaatacagaaaccaatatctataacagagcccaaaaaatataaaggatgtgggttttgcatcttaaactgatcatgttcatgagaaagccatatctattctattctgtggcctttgtacattgtagagggaatcttgaaaaagaactaatatttaaaataatttttttactatattattctgctgtcaccatttagagcgaaaaggagatattttgttagtgtagattccaggcctaaatacacatcacatagaccatatatctccaacctgaagaagctcctggagcttgtttacagtgcctcggtattcaagttatcctgactaatatgctctttccagaaattaactttaaaatattttatttttaaacttttaatgtttgtttatctgaaaaaaaaaaactgcttggcctattgatatcctgttatatacccaaaatatacaaaaaagtttggaggggaaaaacatatgaggatacagccaatattattcaaaacaatatggctaaacatttctatttttaacataatttagtggcaaatcaatgatacataatagcatattattattaagggacaggccatcatttctaaggtgggttttaaaatgtaaaatgtgtttttaatactattaacagcttaaaattaacattttacatttgcctaaactttaaaatttgatacatattttatttaaaacaaattatgacttgaaattttgaggactttatattacattaaatattctctatcaagttatggaaatagtaaaacagagtttattagaaaggaatttacttctattaagaatagccattttaacctttatttaatttaaaaagttgcaatataacacagcttgcattacctgtactgctgacagcattaggcacattcagggtataaatttgagactgcaatattatttaatttgacagtcaatgatgccactctatttttcttgatgtcttcaagtgccttttgatgtttaaagaatgcattttataattacattaaaagttatccataaaaggtaggtatgccattttctcagtaacttttttttttgtcttgctatgtatctttcccactgttatttttatattgcaccaatgttttagatccagcaatctgtgtctgaatttgaagataaacttgctgttccaattaaaatatgttcttcagctacagaaacatacaaagttcttcaagaacatatggtaagagtatgcttcaacatttctactatttaccaacttaaaatttgataattcccacttgaaaagaaaatacagtaaactttttaagagaattgaaattggaaaaatgtttatattagttgagtaattatatagatctaatgtattcactttatataatccaagacatgtaaggatgtgaataaattttcattaaagatgtatattaaaggagtattcatttcaaatacatttctctcttttaattaggatgagtaacatttttagagcttagctttaacaaccctgttacctcttgccagcattataaaaaagtacatgtgcaaggaaaaatatatgtgtatagctgtcttcatattttaacccactgtactcagatgtttaaggaatatatcctcactgatctgtttccaatgattggtttttctcatcattgcgaatcttctgcaaggctacagacagatggctctggcagaatttagggggaggaacaaagggggataattacgtacaaagaaatactacc

SEQ ID NO: 464975 - DNA, 4890 bp, Homo sapiens
acaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagagtatgtgattgacaagtcctaaactttcttctctgagataaagtttcatacaatctttcctgtaccttgtattcaaaacactcttttaaaatctcaaagtgtctgtgtatttcagcatgttttgaggaaacaactcacagttcaaaagaaagtatcgctaatacagaaaccaatatctataacagagcccaaaaaatataaaggatgtgggttttgcatcttaaactgatcatgttcatgagaaagccatatctattctattctgtggcctttgtacattgtagagggaatcttgaaaaagaactaatatttaaaataatttttttactatattattctgctgtcaccatttagagcgaaaaggagatattttgttagtgtagattccaggcctaaatacacatcacatagaccatatatctccaacctgaagaagctcctggagcttgtttacagtgcctcggtattcaagttatcctgactaatatgctctttccagaaattaactttaaaatattttatttttaaacttttaatgtttgtttatctgaaaaaaaaaaactgcttggcctattgatatcctgttatatacccaaaatatacaaaaaagtttggaggggaaaaacatatgaggatacagccaatattattcaaaacaatatggctaaacatttctatttttaacataatttagtggcaaatcaatgatacataatagcatattattattaagggacaggccatcatttctaaggtgggttttaaaatgtaaaatgtgtttttaatactattaacagcttaaaattaacattttacatttgcctaaactttaaaatttgatacatattttatttaaaacaaattatgacttgaaattttgaggactttatattacattaaatattctctatcaagttatggaaatagtaaaacagagtttattagaaaggaatttacttctattaagaatagccattttaacctttatttaatttaaaaagttgcaatataacacagcttgcattacctgtactgctgacagcattaggcacattcagggtataaatttgagactgcaatattatttaatttgacagtcaatgatgccactctatttttcttgatgtcttcaagtgccttttgatgtttaaagaatgcattttataattacattaaaagttatccataaaaggtaggtatgccattttctcagtaacttttttttttgtcttgctatgtatctttcccactgttatttttatattgcaccaatgttttagatccagcaatctgtgtctgaatttgaagataaacttgctgttccaattaaaatatgttcttcagctacagaaacatacaaagttcttcaagaacatatggtaagagtatgcttcaacatttctactatttaccaacttaaaatttgataattcccacttgaaaagaaaatacagtaaactttttaagagaattgaaattggaaaaatgtttatattagttgagtaattatatagatctaatgtattcactttatataatccaagacatgtaaggatgtgaataaattttcattaaagatgtatattaaaggagtattcatttcaaatacatttctctcttttaattaggatgagtaacatttttagagcttagctttaacaaccctgttacctcttgccagcattataaaaaagtacatgtgcaaggaaaaatatatgtgtatagctgtcttcatattttaacccactgtactcagatgtttaaggaatatatcctcactgatctgtttccaatgattggtttttctcatcattgcgaatcttctgcaaggctacagacagatggctctggcagaatttagggggaggaacaaagggggataattacgtacaaagaaatactacc

SEQ ID NO: 464976 - DNA, 899 bp, Homo sapiens
agctctaataatagaaacagttcttgcccggcagcatgggattgagatcacgagctctgtcttgattgataagatgcagtttataaaggtatttctatagaaagcatcactgcagtgtctctcctttaagtgtaagaagaacatttctttggaaataggactattgaaaagctgtgtacactgaaatcttttctggcatagtttataaaaataagtcctggcaacaactggtcacatgcagagtttaattagattctacctggattcaaacccctttggacccagcaatgttttgttcaaagtgcagtttcactcaaagtgtagatactgcctcattaaatgttcattctcagagaagataggaaaacctgataaactactcagaacaactgtgcaattttttttttagcgtgaatagtttcaactttgaaatggtcacaaatgtcttcattatctcttcacctggtgatttcaaggaaaatgtgttgttgttctctattaacaatactgagtttatttacttaatttggttaattttagtattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagt

SEQ ID NO: 464977 - DNA, 2144 bp, Homo sapiens
ggttaaggcaggaaccagccattttcacttattttgtggttcttcagttgcctcaggccatctggatatatacgtgcagacttgggctcagaggcctgacaaggattttctcccacggccacatcaacccacctacgcaattgcatctgtgcccgaatacacgctcttcacttctgttactatgggtgaaccatctgtgctctgggccgaggccaacctctctatgtgtacattagatcccaccctctctccaaaagatagggtctggctctgttgccgaggcgggagtgtagtggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggtgagtcaggacaggacggagacaccgtgcatcctcaatgaagggagaagcttgagcgtgttaaggtccaaatgtaagagaaatttagaaattcctggaaagtcactgtaactatttcgctcatttaaaaactcaaaaaactggacttaaataaaacctgataatatatgat

SEQ ID NO: 464978 - DNA, 1905 bp, Homo sapiens
gagaggagctcgaacaaggaagcggcgggaggaggagatttccttgcaacaaatgtgccaaacctgagtgaatcattcgtagcaaaagtgcagtgtcaagcggctctctcttccaccgcccaagatgccaaaaggaaaaaaggggaagaaggtggctccggcccctgctgtcatgacgaagcaggaggccaagaaagtggtgaatcccctgtttgagaaaaggcctaagaattttggcattggacaggacatccagcccaaaagagacctgacctgctttgtgaaatggccccgctgtatcacgttgcagtggcagatagccatcccctataagcggctgaaagtgcctcctgcgattaaccagttcattcaggctctgaaccaccaaacagctactcagctgcttaagctggcccacaagtacaggccagagataaagcaaggagaagaagctgaggctgttggcctgactgagaagaaagctgctggcaaaggggatgtccccattaagagactacctggcctttgagcaggagttaagactgtcacaccttggtggagaacaagaaagctcagctgctagtgattgcacacaacgtgtggcacacaacgtctggttgtcttcctgcctgccctgtgttgtaaaatgggggtcccttactacattatgaagggggaagcaaaactgggacatctagtccacaggaagacctggatcattgtcaccttcacacaggttaacgtggaagacaaaggagctttggctaagctggtggaagctatcaggaccaattacaacatatatgatgagctccgccatcactgggaaggcaatgtcctgggtcccaagtctgtggctcatattgccaaagcttgaaaaggcaaaggctaaagaacttgccatcaaactgggttgaatgtacactgttgagttttctgtacataaaaataattaaaaaatcaaggattccacatttactttgaatccctggtttcttccaaaagggaaatgccacaagactaggccgtgcaacatttccgcagtgctcctcgctacaaagacattcccctaaggctggtgggcaactcaacactcagctcagtacgtggtcagctcgtcctccataggagccttatgccttggtgaggagatctctgaagaaattgctgatgaaagtccaacaggctcttccagtttgtctggtcggtcacatttgctgaaacctggaggaattgttagtggaagctcaacaggcctgactcagtctgactgtccattcttctggaagctgcagagaaaagaaacctggaaaccttatatgctgacaaaaagggacacaattggatatgatggttattttaccaaggttttgaaatgtcgtgctttcaaatataaacagactgctttaaggaatcgaagttgacttatagagccaataaaagccctgcaggaaagctggcctcatactttgtctacacagtctctgtacaggtttcctgacctgtgtttgttaatatggtaaattacattgcttgatttaccaatgctaattcaaccttgcattcctaggataagcccctgtttggttataatgtattatcttttttatatatttttatgtatttatatatttatatatcttttttatataatctactttttactgccttgtctcatgtaaacctgtgtaatttcccattgggtccaccttaggaaacagtctttaaagttttctccgtaaagcaagtaccagtatactcttttatggtcaatacaatgctaattcaaccttgcattcctaggataagcacctgtttggatataatgtattatcttttttatatactgtgaaataaaagtgactagaattgtgcatattatgtttatgagagatattggtccat

SEQ ID NO: 464979 - DNA, 3176 bp, Homo sapiens
cgcggtggcgcacgtctgtaatcccaacactttgggaggccgaggtgggcagatcacgaggtcaagaattcgagaccagcctggccaacatggtgaaaccccgtctctactaaaaatacaaaaattagccgggcgtggtggtgcgctcctgtaacctcagctactcagaaggctgaggcaggagaatcacttgaacccgagaggcagaggttgcagtgagccgagatcgcaccactgcactcaagcctgggtgacagagcaagactctgtctcaaaaaaataaaaaatagacattaaaagaatcctgggaagacattaccgagtggaagatgcacgtgttctttgtgttcttatctcttctggagacactgaggagacttcctgtggctgatgtcagtgtgcctcatactggggaaaattgcagcccccggatggaagctgctctgaccaagaatactgtggacattgcagaaggcctggaacaagtccagatgggaagcttacctggaaccatttcagaaaattctccatctcctagtgaaagaaacagacgagtaaattcagacctagtgaccaatggattaatcaataaaccccaatccctagagagtcgagagcgacagaagtcatcagatatcctggaggaactaattgttcaaggaattatacaaagccacagcaaagtatttagaaatggagaatcatatgatgtcacggcaagtaattttgtaattaacattagcttatagttaaaattagcaatagaatatgattgatcatgagtcattatttccagcatatgcaagttacaatacagataacagcatttatttaagtcagatttttctcccttaaattccccccacatctctgcacaccatctcatatggtttggttctgtgctcccacccaaatctcaccttgaattgtaatcctcaggtgtcaagggcgggaccaggtggagatatccttaacatatatatgtgcagagtagatatctgggaagacacacactgaactctttacaaaggttcatgctaaggactgggattgggggccatgtggttaaatagaggataaggagatgatttatgtatcagttatattttttataatcaatctatattatcttaaaactaatttttaaaacaaaacaccttaaaactttcttcataaatactttatgacaattttacttattttggaactagaaattataattagaaagtcatcattactgctttgaactgttgaaagggtagttgatcatatgaagtgggatttttcccccgctgtcatgaaaatgtttgtcaagttcctccagcaaagcccagaacagagttgttgttcagtaatcgttaattatctctttctaccacaaaaccagaagcaatgagaactaatctctatcccagatgaaagtaacttgtagcttgtggaatattataaaatcatcaggttgaactcttcaccttaaactacaaattcacccccattctccactgcttttcatcttatattcattctcaagattttttccttctaagggttcatcttctatgcagtctgagaacacctgcattcatagggcctttttgtaatagcctggtgcttttaaggcatctaaaagatcttatcgttataattctgttgttatcaactttcacgttggtttttttaatctgcgcctggaaagttagatttttagaatttactttattcatttatttatttatttatttagagacagggtctcgctctgttgccaaggctggagtgcagtggaacgatcttggctcactgcaacctccacctcctgggctcaagcgatcctccaccctcagcctcccaagtagctgggactacgggcacacaccaccatgcctggctaattttttgtatttttgtagagacaaggtttcactatgttgcccaggctggcctcaaactccggagctcaagcagtcttcccaccttggcctcccaaagtgccgggattacaggcatgagccactgcacccagactagaatttacattttaaactgtttattctaactcttttgcccttctcttctgccagtgaatatgattgtttcttcatgtaaaaagatgttttattccagttgactacgactgagaagccattgagaaagccaccttccagactgaaaaaactcaagatcaaaaagcaagtgaaggatttcacaatgaaggacatcgaggagaagatggaggctgccgaggagcgcaggaagactaaagaagaagaaataagaaaaaggctacggagtgaccgacttttgccttcagccaatcactcagattcagctgaattagatggggccgaggttgcatttgccaaaggacttcaaagggtgaggtctgctggatttgaaccatctgacctgcagggaggaaaaccattgaagaggaagaagagtaaatgtgatgcaaccttgattgatagaaacgaaagtgatgaaagttttggggtcgtggagtcagacatgtcctacaaccaagcagatgacatagtctactaagccattttttgtgaatttcataagaaagcattcattctccccatttgtgacatttgtagtatgtctcatattctttgactgactgacctcattccactgggatttctgccttgggcttaaggatgattgtgtgggctgcacaggctgaaggttagttgagtaaattaagtagctatgctagcttttaaaaaaagagcgagggggagacttgaccagcatagatatttggcactctcctttgtgtggcttcaaacattatggagatgtctttaattcatttataagtgccttcagtttacattaataagttcgtgccaaatgaaatccttcctgtttactcctgccttgtggcggggtccatcctctgctgctcctttaaaacaaattgcatggatttgtattaagtattttaatggcttatatgttttttatgctgtatgtctatggttttataatttttttctctgtgttgtgaaggaataaagcaatgtcttgaagttggctgaattacagttttatccacatagtttaagttagcaatatctaattctcagaattacatagagttttcttcttgtgaaaacagaagaacttcagttgaggctagggatggaaggaagttgtgagggtgc

SEQ ID NO: 464980 - DNA, 1770 bp, Homo sapiens
cgcagtagctcaggcctgtaatcccagcactttgggaggccaaggcgggtggatcatgaggtcaggagatcgagaccatcctggctaacatggtgaaaccccatctctactaaaaatacaaaaaaaattagccgggcgtggtggcgggcgcctgtagtcccagctatcagaaggctgaggcaggagaatcacttgaacccgagaggcagaggttgcagtgagccgagatcgcaccactgcactcaagcctgggtgacagagcaagactctgtctcaaaaaaataaaaaatagacattaaaagaatcctgggaagacattaccgagtggaagatgcacgtgttctttgtgttcttatctcttctggagacactgaggagacttcctgtggctgatgtcagtgtgcctcatactggggaaaattgcagcccccggatggaagctgctctgaccaagaatactgtggacattgcagaaggcctggaacaagtccagatgggaagcttacctggaaccatttcagaaaattctccatctcctagtgaaagaaacagacgagtaaattcagacctagtgaccaatggattaatcaataaaccccaatccctagagagtcgagagcgacagaagtcatcagatatcctggaggaactaattgttcaaggaattatacaaagccacagcaaagtatttagaaatggagaatcatatgatgtcacgttgactacgactgagaagccattgagaaagccaccttccagactgaaaaaactcaagatcaaaaagcaagtgaaggatttcacaatgaaggacatcgaggagaagatggaggctgccgaggagcgcaggaagactaaagaagaagaaataagaaaaaggctacggagtgaccgacttttgccttcagccaatcactcagattcagctgaattagatggggccgaggttgcatttgccaaaggacttcaaagggtgaggtctgctggatttgaaccatctgacctgcagggaggaaaaccattgaagaggaagaagagtaaatgtgatgcaaccttgattgatagaaacgaaagtgatgaaagttttggggtcgtggagtcagacatgtcctacaaccaagcagatgacatagtctactaagccattttttgtgaatttcataagaaagcattcattctccccatttgtgacatttgtagtatgtctcatattctttgactgactgacctcattccactgggatttctgccttgggcttaaggatgattgtgtgggctgcacaggctgaaggttagttgagtaaattaagtagctatgctagcttttaaaaaaagagcgagggggagacttgaccagcatagatatttggcactctcctttgtgtggcttcaaacattatggagatgtctttaattcatttataagtgccttcagtttacattaataagttcgtgccaaatgaaatccttcctgtttactcctgccttgtggcggggtccatcctctgctgctcctttaaaacaaattgcatggatttgtattaagtattttaatggcttatatgttttttatgctgtatgtctatggttttataatttttttctctgtgttgtgaaggaataaagcaatgtcttgaagttggctgaattacagttttatccacatagtttaagttagcaatatctaattctcagaattacatagagttttcttcttgtgaaaacagaagaacttcagttgaggctagggatggaaggaagttgtgagggtgc

SEQ ID NO: 464981 - DNA, 2732 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(12): n is a, c, g, or t
ctnannantgnngccacagagctcaaatgaaggcagtgggacagcgagaccccactgggaccacacagatgcacaagctgcttcaaacctttcagggcccttaaattcccagcaactaaaaggaaacaggccgcctggggtgctggaaaccgccggcctggagtcagccgaaggttcgatttgtcctttctagaaaccgtgtacacatggactcctacaatccagtcctttgtgtctggcttctgtcactcagcgtcgcatttctggggctcatccatgttgtagcatgtagtggtattccattgattggctacactgtagtttctccatttgccagatgatggatgcttggattgtttccagtttggggctattttgaagaacgcttctatgagcatttgcatctgagttgtatggacgtatgttttcatttctcccggggagatcctaggagcggagttgctgcactgcatggtgaacgtatgtttaactctttaagaaactgcctcgctgacttctgaagcagctgcaccgtggcgtgttcccaccagcagcttatctcgtgtcttcacatctgctggaggatttgagcagaggagagatgtgatgagacttgctcttcagaagattcctccagctgccgggtgagggtcactgagagggaaaggaagaggcaggagggagaagtctgggtcctaggctaaagctccggctctgggtggaccagagacaaggagctggagtccagggatgtgttcaacagggtctggcatggaaggagcaggagccacagagactttggtaactggctcagcctcaatcagcaagtggctgagagagaaaagatggaggtgacttgggagcaagacttccatctggactgcgatgatggtgccggggcctctggctcttgcctgtccatgcatcatgcatggccagatcagcagtcacatcccttcagaaggttcccacatcctgtaaggggagtggctcccagtcctggctgcccttttgaatcacctggaaaactttaaaatctgctggctgggtcctgatgtaactgatctgcgcacagcctgggcatggagaggttcaagctcccaggtgatttgaatgcacactgggctgagtcaagctctcaggcgcaggtgcacactgggagctccaggggagttttacaaactactaaagtgctgagtcccacccagagcttttggtgcagttgggacagggggaagcctgtgcactaggagttgtaacctttccccgggtgattataacgcgcagccacgtttggggactgctgcttgaaggcaacttgtttggacccaagagtcagttctgagcagatgcttctaatgctagcatttcctaaaagagtgttcttgattctctcgctctttataagtagacccagaaatcttttttttttccttctcaatgtacagattatttttctgaagcattttatagtacatgttgctaaaaaataaaaccagattccactgcacgtgttctgtaaacccatctggtttacataaaatatttacaaatgcagatacagaggaatttcaaggtatttttgggtaaggaaccagcatgttagctgtgtgttgcctgctctgtggtctccatagcatatgatacataaacaccagtcagatacagggatgaactgcgttcctacagatgaggtgtgaggttcagacatgtgagagtccatgcctgtcacacagccgcccaatgtccaagtcctggtccaggcattttgcccgaggccaccgtgctgcaggggcgctgtcctggtgggaccatgtgtggttgctgcatctgtcctggagaacagtgcctcggggccagtgagtacgtgaggaggagcccgtctccctctggcatctcttcctccaccatctccctgccctgtgctcctgcagcaggccgctcatgtctttacgtctgtatgaactcacccagggcatcacgtgagggctgtgggatgctgcctgactcccaggcaggagcccagtattctctgcacgctcacactctgtgctcactctgctgcgcacgtcacacgtggacatacatggatctttcccacggaggggactatgagccccaggatggaattgtgcaactggtgccattgatgtccttaggaaatcggaacccgtttctggaattcttgacagaggagcatccaagaggccccgctgggcaccctgccgcggctcctggacacagagcacaggcccagctggcagtcactccggacactcactcagtccttgtcacaaggagttccgagcagcagaatgaggaaggggccctggaagctgcccctggttccctgttatcttgcaatggacgaggcttcccaatactccacatccctgccagcatctggtggttcagtgtgctggattttggccatactcatagcagcagagcagaggacatgactgggccctggatcaaagggttttccctgaagcctggctgttccgtgtgtgcgtcccgcagagcacagtgcttgccctagaatgctgggcgggcaggcccaatttcacattcacacgacattccatgcccaatgcggcgaagatgttttaacaagcacctccatagcctgtaggcttcatcctggagaggactggagagttgctttggcacctaatgcagggcaaggcagtgtgaatgaatgaatgcaggatgcatgaatgaatagctgc

SEQ ID NO: 464982 - DNA, 810 bp, Homo sapiens
cttctggatttaggaaaaacacgtatcgacgaaaaagcatcaaactctgtaaaatatctgaagagattggttctgagccaaatatgagtgaccaatggcctgtgacacggcctgcaggagatcctgagaacatgtggccaaggtggaccctcaagtcccagtcgctgaagcctccttgctcattcccctgggagttttcagtcagcctctgggtccctcttgttagtcctcctccatctgcctacagcaaaaggtttcactgtcttgtaatgagagtctggcaagacagcctggctgctgatgactcttatcctagaagggacttcagacgtcatctcccttaccctcatgcttctgatgacacctatcgttatctgcaattttatttattattgacaccaccagaatgtaaattccatgagggaaggggccttgcttctctgttgcattgccaacagctagaacgcagtgcctgctacacagtaggggcctaataagtggtggttgtgacggacacggtggctcaaggcctgtaatcccagcactttgggaggctgaggcaggtagatcacttgaaatcaggagtttgagaccagcctggggaacacggtgaaaccccatgtctactaaacatacaaaaattagctgggcgtagttgcgtgcacctgtaatcccagctacttgggaggctggggcaggagaatcgcttgaacccaggaggaagaggttgcagtgagctgagatggtaccactgcactccagcctgggcgagagagtgagactctgtctcaaacaacaacaacaacaaca

SEQ ID NO: 464983 - DNA, 1538 bp, Homo sapiens
ggtgtacaagtcgatgacgacgtcgcctaaagtggccgacggcgtcgtctacgccacgcgtcaccctcggcgcgaccccttttgcgtcatctcgccggcgccgcccccggttccgagcagttccttccggtcggcgtgcgggcgccgggctgcccagctgacttacggatcgggttggtcccgcccccggcgcggccgttttgaaaatcctggtccgcccttggcgattttggtggaagcctgtccctcagaacggtctcagtatagtgttttgtgccccgtttgtgtccgtctcaagagcagagcggccctccgcgcggcccttttatccaccagggggcgcccgcggcgggatcttctctccacctatttgggcggactcctccgggtttcctcgtcagtctccttttcgcaaaacaactttgggcctctactagggtaaagccaacaaagggaatcctaagactgtgagttctgggtcattgtaaggttcctcagtgctgttgaactgagcaaaccatttaggacagacccaacaattagtcttgttgtagaaatgggccatggcggatattgtaggagctaaagggtgtgacgtattactaagtcccataaaaaatcctaacagacctagtgatagtaaaacactcatgtttactgttggttaataactgttattcctgctgtaaggatagtaattaagcaaaatgctacagtaattgagattctgttcgatattacaccctgagggtgctatagtatatagtaatacttggcttaaaaggagaggtagaaacggcaaaaagtatttggtgaggtagaggcgagactaagtgaattaaataaagtgaatcctgacttaaaagaagaaaatccactcccaagagggaaatccactgaaggcagaggaaagacaccctacactctgcttctgcttccaagtggaggcttctttcatttctaaaggggtctttcaaaaagttcaaaaatatgtagatgactaactctggaaaatactggagtagactgtgttgtaatagaagtgcagtgactcactcactcccagaaactggaaacagatacaaatcaggtcccagatttccttttggcatcaagcctgctttaaattgcagaaaaagatggactcaaattttgattgtgggaatgatgaaaatgacaatgaaatcggctactgaaaaaggaaatatatcaaggtttggaatcaaaaggtattatctggtgaaagaataaagacattttaatatatactttgttttctgtagtattagaaatattttagaatatcttctcctatatgaaagattaccttcaaagaagagaaagcatctaatgtgcacagaaccgcagtgggttgctgtcaggcaacttgaactctttttatgatagaggatatcaagttgacatgagctgactcaaaggaacatcaaagtactcaccgtattaacattgacagatttatttgtcgtgtaagcaactgccaagttaattctgtcttttgtttctcagattaatgtgaa

SEQ ID NO: 464984 - DNA, 1101 bp, Homo sapiens
gtatctggaagcatctaaccaccatgaggatcccaatgcctccatggataccgagcttttacatatttcctgaccatgcttcccccgtaaacttcaacaagcttgttctggggatgaggccacacatcaggaaacactccagcctcaagggaagctgtaagggaggctgcttctcgccagtcaacctccatcagtcactgaatggggcaccgaaagagagtgaaggcaccagcctgcattatttacccctgcacttccgggccggacatgtgtggacccgcagcagaacctggaagagcaaaggcagctgggaaatgtgtgaggccgtcataaaccctctacctgctaagctgacagctgactccctgcagacctcaacagaccttcgctgctgttgtccatttatacagaacaagggcattctctctgttgcacgtcaggcttccacatggtttttgagttaaaaatgtttaggtttcagaatgaataacccataactaaccacaacaatatgggtaaatctcgtaaacatgatgctgagcaaaagaacccacatgtaagaaagtgtgtaggataggatttcattcatatcaggtacgaacgcagccacagtcactctatgctagagccctgggagagtgagagacaggtgcatgcaagggacttctggagtgcagccaatgtcctgatccctgacctggctgctggctacagggttgtgcagttatcaagaaactaagcatatggtcaaaacattcaagaaacacagcgggaaattctatgactcacacacacgtgttaagaatgatgtgaaatggagcacaaggttttcagtgttacatttctaccttaaaatggtccaccgtatgtgttacctttctaccttgactgtaccttacatatgacttaataaatcataataaataaatccatgtgatagaatttattcaggtattataaagacatgagaagtttttaatacaaaaaatgtacattaataagcacccttgagaaacacaaaatgtagcaagggacacagacaaatgaacaagtgattgctctgtcatatgaatgctgcttcactgagcttaggagcctcac

SEQ ID NO: 464985 - DNA, 1649 bp, Homo sapiens
ccctctccccagctccctctgcttcagtcacactgacggccccagtacattcgtgcttgttggtccttctgcctggaagtgcccagaatgggcctttggaaagcatcgagcagcctctcttgctcagtgggcactgaaatggcactcggagctcagtacccagataaaggacaccccccagataaaggacaccaccccttcccccgcgcaggcctcgggaaagggcgaggccgtggtgagaatggcggggtcagcggacagcagtggggctacaggctgtgtctgtggctgccctggcttagggctctggctggcccctcctttccgacctggtctggcagagcagccccgcaggaccagctcgcaaggctcctggggccagtggggctctgtcctgtgaggcggtccctccgcaaggacagagtcagagagaggctgaaaccaggtcctgaaaaacatcacagaaactacagctggaaatttcctgttgaccctgatagactactacttgacaccagccgaccgatctgctggctgcccaccatggtcctgccacaattctgatgggacagagaattggccttactttctttcctgataaatagccatagacctcaagccagccagttttggccagcttatagagactgtacacaaactgagccctgagtgatcaggcagtcgtagaagtgcatgaggtgccaggggtttccttccagcagaacttgccttctttatttgttgggccagtgacttctcagttccagagttattgccttgatggtccatgagtgctgttttgagattgacccccactctctcttgaatgaaatatatttcatctcttttcttcttgtattgatatgttaatatttattttttaataaagactttgtgaaggattagcattattttttggttaaatatttgataaaattcaccagtgaagttatctgggcctagaattctctttatgggaagattttacatttctaattcagtttctttactttttataggcctatttagattgttctgtatattttttagttcattttggtaatttgtacctttctaggaacttttccacttcatattagttgcctgctttgttggcataaagatgtttacagcatttccttgtaatttctataggatcagtagtctattctttctttcgtccctttattgggtaatttttatcttctctatttttttcttggtcagtctaaaggtttgtcaattttgttgatcttttcaaataatcagcctttaggtttctttggttttctctatttttccattttctattttgttgatttctgctcttatccttattatttcatttattttgcttgctttgatcattttaacttgcccctccttttttagtttcttaagaaattactctagaatgtatactcttctcttgttaccattaaaaacttaacaggattttactttgatttttacaaaagacacgaagtgcaattacctggattagcttcttctatgaagaaaaataaagcagcctaacagggtagagattgatagagtctactatcttaaatagagagactaggaaactctctcttagtagagtcatttgagtagaatcctgaaggcagtaaaagaaaataacatttcac

SEQ ID NO: 464986 - DNA, 3369 bp, Homo sapiens
aggtgtaggggggatatacgtttctgagaagcacacactgactgacatgtgttggttactacatcagctgataacatcgagacctatggaatacaaatggattaatcagatgacccaaagccagacctttcccatgacggagatgaacttcctgaaccacccagagtgcgaggagaggaggagtgactctccagaggagaatgaggaagcccttgccacctggtgggggccagaaagaactcacctccaccagcagctattaggtcctccaaaaaccctaggagcatttagcacatggggagatctccactggggtcccaaatgggctgccctcctgcctctggtgctgactctgactagacatcagatggcacagacaccatgcttccttcattccaggctgctccctgggatactgtatgacgagcactttctaggccagcagaaagccaaggtgatgccatctttgcacaagccttttgaaagccaaaccaccatgagaaatatggtgtacctgaggagcgccccgagccccggcccagctcctcccgctgcatgccctaggagcccaccaagactgaggaagtggagaggctggcggcgatgcgttctgactccctcgtcccaggcacccacaccccacccatccgcaggagaagagagcgagaaagaccagtggctggagaatggagagctgagtgtcgtgcgggttgaggctggagagaggcagcagagcctacagagaagacagatggcccactggagtttggaggaaaaccaggagggactggtggtctcggtgaaccagaggagagagtttcagaaagaagagtccaccctggcagatcttgacaagatggtgtccggtgggcatagacaactcatcattggtgtcctttgggattatgactttagggaagccacgtagctgggatttagatagcatgtggttgaggagtaaatgagaggagaggaggtagtcatcttcttttaagatgtttggttgagagggaaaatgagaaatatatagcaaacaacaaaaggggatgtgagcttgagggggatgttttttaagattggttagattgtgtcaagctgcaaaatttgccttaacatggctgtggcattctcagggaaattgaaacatcagcaaagtgactgttaagccaaataaatatatttgcacacatttttcagcaatgacaattctcgtgactaggaaaagcaaacatgcaaataatcagagcactagttagcatctgattttaataagaaactatcaaaccaagttgaatagccttcagcatctggccagatcacatattccctttgggtgaatgattggagcatttcatttcttctttaaaaaaaaaaaaaaaagatccagcataggtaagcagggaatatttttagttgtgtattcatcatgacccacaaagggaccatctagtggttagaaagcaaagcagacttaatggtcctgttttgtttttaaaaaatctctaacaggtacagactaaagactatggaaatctgttaccttctagggctggataaaagatgtaattgtttcttctcaaagtgaactttatccagcactctctgcgtgtagaatgtgcttcaacaatgttacactgatgacaacagcaggagcaatcttctgttgtgctctgctcatattactatgtcgtatgaaatatacttgaccctttccttgccttatggacttgaatcttgcatcagacccatatagtattattaacttcacttgacaggtgaggaaactgaagcttagggagactcaataattgccagttagaaataacagagctggaatttgaacttagcctgcagtcttctcaaatatatcgcatttcagatccatgagggtggaaatcgataattcagatgctttaaaacataattcttctacacataacagtgatattacaagatgctttccttttttgacgtatctctataaagaaatgtgaaggaagagaagctcatcaataaaaactgacactggaagccatgatacgagtctttattgaaagtctttaaagaggaaagtcaaggtgtagcatactcgtctttgtatgaaccccacagtatctagttcaatgccatgtacttggaggatgcactctatttgttgaatagctaagaaagagtaaattgatactggcatgaaacaaaccttcagaatcattccatttatgttttcaatataactatctctttctgctgtatgatatataggaacaaaatatgcattgattagtcgaattacagttgtgtcctttcatttcttcactgtcactttaatctagatatgcattggtgtcttttgggtttccccagaattctttgaccttttccctttgacttttattcactaaaaacttaataattatgttattaatatacattagcactactagtaacaatggtaatagctagtgcttgagtgcccacctgacaagtgtgaactagctgcaatctggctctcagcgccccagcagtcctctgaggcagttacttagttatgcctaatacctgtttgatagaagcatttaatagtttttctcttcttcctgccatatttccctttgattttcttttttagctctaggatatttactaagtgccttcattttttttaactgttaagttcagggcatatgtacagatttgttatataggtctttgaggaattgccagactgtctcccacaatggttgaactattaaataatttacattcccaccagtagtgtataagtgtttcattttctctgcaacctcaccagcatctgatattttttgactttttaatgatagtctgactggtgtcagatggtatctcattgtggttttgatttgcatttctctaatgatcagtgatgttgagcttttttcatattaaaaatatgttggccacttgtcattttttgaagtgtcttttcatgtcctttgtccactttttaatgaggttgttttgtttttttcttgtaaatttaagtttcttatagatgctgtatattagacctttgtcagatgcatagttgcaaaatttttctcccattctgtaggttgtctgttcactctgttgatagtttcttttgctgtgcagaagctcttaagtataattagatcccatttgtcagtttttacatgtgttgcgattgtttttggtgtcttcttcataaaatctttgcccattcttatattgagaatggtattacctaggttgctttcctgggtttttatggtcttggattttatgtttaagtctttaatccatcttgagttaatttttgtatgtggtgtaaggaaggtgtccaatttcagtcatctgcatatgaag

SEQ ID NO: 464987 - DNA, 698 bp, Homo sapiens
cccgggtccctgatgaccttgtatgtagccgttccagacctggactgtgcacttctggactctggtgacatgcagggaaaaaaaaatgaaacaaacaaaaaaacacgtttaggtttactgcacttgcctctagcagttatggaattctatgccactcaaatcctctatctgttgcaaaaatgtgcatcccaagatggtgctcttgagctgtggtgcagtatcttcagacagacactgtggctgctgcttctaactgctggcttccagcctgctgtctgccagctggctctaccctctcctataacacggcagagagtagctgtggtctcctgcgtgctcaccctctgctcccttggtcctgctccatgctttggtcctgcacttaaattttacaagcatactctctttctcttaagtaactgcctgaaaagccaagaagtagagtgacggggtggtgttgaaggtggcagactgatgaagataaggagaaatgaatttggaaaaggagggaggagcaaaccaatgaagagttgtaaaaaccagaaaagcaattctggattagatttagaagtggcagaatgacaaggtgaagttttctatagggagaaagttgctaggttgcctcatttgagacagcctggaatttttgaaaagcggaaattaaaaaaaaaaactagagcagtgtgatcattcacaag

SEQ ID NO: 464988 - DNA, 3019 bp, Homo sapiens
  misc_feature (2764)..(2764): n is a, c, g, or t
  misc_feature (2794)..(2794): n is a, c, g, or t
  misc_feature (2836)..(2836): n is a, c, g, or t
agataccttaaatcatctctctcaagttcaaagttccacagatctctagggaactctagaaaaaaattcttattttcactctttcccgcctatcttatgcccgtttctaacacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacatgttcgggtatctttacagcagcaccccactctactggtatcaacttattgtattagtctgttctcacactgcaaataaagacatacctgagactgggtaatttataaaggaaagaggttgaattgactcacagttctgcatggctggggaggcctcacaatcatggtggaaggcaaggaggtgcaaaagcatgtctcacatagtggcaggcaggagagagcatgtgcaggggagctcccatttataaaaccatcagatctcatgagacttagtcactaccacgagaacagtatggggggaaccatccccatgattcagttatctgcacctggccccacccttgacacgtgggaattattacaatgcaagatctccgtcaagtgcagtaaccagttcaagttggaagtgtgtcttttgaaatcagaaaacaaagtcgtggacaaccaggctgggacccagggccagctgaaggtgctgggtgccaacctctggtggccgtacctgatgcacgaacaccccgcctacctgtactcgtgggaggtaatggtggtttgggacttgcttaagggaggtcttttgctcccatctggtagccctggcttcagcaggagcccaggacaggtgaacgggcagggcaggccagatggggctcaggctgtcggggcgctcacacctggcgctttggctgtcataggtgcggctgactgcacagaagtcactggggcctttgacttctacacactccctgtggggctccgcactgtgcccgtcaccgagagccagtgggctctgtatgtggatgtgatccgtgtgaacagctactactcttggtatcgcaactacgggcacctggagttgattcagctgcagctggccgcccagtttgagaactgtgaagagtaccagaaaagtctgctagagcagtaccatctgggtctcaatcaaaaacgcagaaaatacgtggttggagagctcatctggaattttgccgatttcatgactaaccagtccaaggatgaaggaaaaactggacctcattatggatttacttttgggatacactcattattccagaggagggtaaaaggctgagaagcttaaggtatttcagtctgttttatgttactcatttgcgaaaagtaggctcatcgaatacagggatctcagtcttttaatataatcaattgactggatgagccctacaatattttggaaaataatctgctttactcaaaaattactgattttcatgttaatctcatctaaaaatactttcagagcaacaactagaatggtatttgaatatataactcttttaacttttaaaatatcaaataatacagttatatatatatacacacatatgtatatatgtcacctaaattgtagatatcagaaatcagaatgctgtgatatgaatatttagtatattttaatcatgataaattatacatccttctaccttatgataatggattttaagatctatgctgttaaactctatatttaccctttaattcatatcttgcttattttacatttatctgagaatacattgggtctactaaatctttactatcactcacagtcttacgttttaagataatttttcaataaaataaaaattcttcattgcacctagaaaggagcagggttttgaaagtgatcaatgattactctaatacctaatataataatataatatagtaaaaatcaaaatacttgaatgaaaaatgtaaaattaatagttttgctttcattgtttttattccagtgtccattttagaatgtttttactctaattgtgtttttatgcaaaaccaaatgagctttagataattccattgatacattacatatgaaagttctcgttaaataggatatagcatattttacttaaaaatccaaattataaaataaagagggattttaagttgagtctaaaatttttgtttcaattttgtttttatttaaagacttgctataattctgtgagagagctataaaagtctactcagaaacattataatgtaaaatggccagagaaggacaatgagatatttaatttgccacggcaaagccattgctgtgaagaatggataatatatgtcaatggtaatatatgaagaaataacacaggtgaatagcagaggcaataaatctgtttttaccacaggacttgtcttacacttttctcttagtaataaataaaataattttcgaccagatggagctggcttgaaatcctcttgtttatggcagtacatatcggttatgattcaaaaaatatagcccatttccaaaaacctgcaacaaagagatactttctcaggtgattgttcagatcattattcattacaaagtgtcagttttgtctttattgatcctcattattgtangaaagtatgtggtcttgtctccattctatnaaaacaacattgtagagattagcactgagtctttccagccanatgcatctgttcatttccgtctccagcttgagtttttagttctgcaggctgtacaggaagcacagcggcatcttcttctggagaggcctcagggagcttttattcatgacagaaggcaaagcaggagcaggcttgaatggttgtttgtgttgtgactgtctgcgcggggagtgatgcgtatgg

SEQ ID NO: 464989 - DNA, 444 bp, Homo sapiens
tgcggcagctgtgctgtggtgatctagaggatcccactagtccaggtcggcttgggctgccaaaacaaaatacaggagactgagagcctcaaatcacagaaatttatgttcgcacagttgtcgaggctggaagcgcaagatcagggtgtcaacatggtgggtttccaaggagggctctcttccttctttgttagacggccgtcttctcactgtgtgctcacatagcctcttcttacagggagagaaagagagagagatcctcacaggccaccaatgctcttggatttgggccccacactcatccttatgacctcattaaacctttatgacttcctgcaggttatatttccaaatacaatcacaatgaggattacagcttcaacatgtgattttgggaaaacacagttctgtccacagcttgcttgtcaaagaaaaggagattaa

SEQ ID NO: 464990 - DNA, 853 bp, Homo sapiens
gctgcccagtgcatgaatcaccgaatgctcaaatcaacttatgaaaattgtaatcaaagccgagaacttggctctaggctctcagaacttgaccgtgtctttgatgttgccccactgatgacctgttcatctgaagacccagcccagaaaaggcaggtctgcttgcctcatggaacagagaaccagtgtcacttccaacccattcaaatcctcacttctcctccatcttttaaccagggttgtttttccttaatgctgatccacaaatgcagaggttcccatgagaatgccatgacaatttactactctgttctgagttttgcaactgtgtttttgcatggaggctactttaagtgcatctgcactgctgccaaacacaggctccaccacattcctggagagggcttcctgggacccacttagaaataaccgacagagcccatgctttgaattagtcggcttgggctgccaaaacaaaatacaggagactgagagcctcaaatcacagaaatttatgttcgcacagttgtcgaggctggaagcgcaagatcagggtgtcaacatggtgggtttccaaggagggctctcttccttctttgttagacggccgtcttctcactgtgtgctcacatagcctcttcttacagggagagaaagagagagagatcctcacaggccaccaatgctcttggatttgggccccacactcatccttatgacctcattaaacctttatgacttcctgcaggttatatttccaaatacaatcacaatgaggattacagcttcaacatgtgattttgggaaaacacagttctgtccacagcttgcttgtcaaagaaaaggagattaa

SEQ ID NO: 464991 - DNA, 1782 bp, Homo sapiens
ccgcgcccgccgcacagcgccggccgccgaaggtttgcctcccaggaagcagcaagcgcctgggcgcgggcagggaggggaggggagttacctgcccagcgtcaggtccgcggagggaggctgattccggctcgaaccgcgcctccccgagacaaggtgcagcgctggagggggcgggagtggagacggccagaaagcgctcggaacctgtctgaactcaaacaccctgctctctcccagcggagtatgaaaaagcctttctttcctgcccgccctcggggctacggggcaattacaagtcccgacaccctgctcctggtctggggcgaggagcgatcccggaggacagcgacgctcacctgggaagaaggcggatctaggccgagcggggccgtggtcccgtcctcgcttttccctgggctcaagaatgcctggaggagaggcctgggggccgcgggtgagagcaagggttgtagcaccttcgagagtgtggggcggattcagcccacagtaggtaattccagtgggcatcccgcagtgcagactccttctcagtgcctaagagtctttaggcttggagaggacgtggggagtggaaaagtagaagaaaaagtgcttgtgcctttacttttttatgtaaaagaatttcaaatatcatcaaagattttggtactgactctcaactgaagtctaattttattaagatatgcactcatgctaagtcaagtgaaatcacaaagaaagaaggatatatctactcgagtgttcattattaaaagcaaacaaaagatcagaaaatagacgtggagagggagaatctattaaagagtcactatctggactggatttcacaaacttcaactgaggtctgggatataacttgtattttttataattaagacagagaaaaagagaaaacaacaacaaaaatgaagcaagagtaaactgccaactccaactgcctttctggaaggcctaatttgaagatgtctgaaattctgtatcactggctcccagacatatcatgtttatttgtacatcacacctttgcccacctctgctcagtggacctccagcctaaaatgcctcccttgttcctctgtctcacttcagctgttattgaagtctcctggtacaatgtgacatttccagcgtcttgttttccaatcagatcagtggctctcagtggaccaactgataaggaacatttggaaaatgttacgatgattgagggctgtactggtatttggtgggcagggaatgacaatgtcctgtgatgtatccatcataatggaaaattatctgatgtcttgggcaaataacagcagtcctgccagacaaaatgaaggtgaaaaattcatttataattgcctaagttcagagcttctctctgttttacatacaagtacaagaaatgtttggcacagttttaatgtatactgaattataggaatccaattacaatatattttgcttaacatagacatctgctaagaattattcatcattttgtagatcacagcactacgtaactgcttcagagatataataaaactcatcagtcttccttagcatctgtaggtcagtcatctcacatctcacagcttcttctgccttctggtatatttgtgtatgaatgtttatatactacaacaaatagcatttttataaattccttttatttactttataatcaggacataacattacttttaaaagttatatgtaggttaaattacattattaataaatttcattgttttagtgtagcaagacaatgtt

SEQ ID NO: 464992 - DNA, 1060 bp, Homo sapiens
tcctgtggctatggaaaggcatgtaggcttcattctcagtatgatgggaaacctctgggaaattttaatcagtgcgacaatgaagcaaactaatacaggaacagaaaaccaaataccacatgttctcacttataagtgggagctaaacatggagtacacgtggccacaaagaagggaacaacaacaacaacaacaaaaggaaacacaaagaagagaaaacagacaccagggcctacttgagggtggagggtggaagaagggtgaggatcgaaaaactatctatcagagaatgcctggagaatataagtttttaaattatttcgttaatcaactcactgaagctcttacccggctctacaaattactgaagtccactgatagtccctccttcgtgaagcattcctgaagaccccagcctgacagatctccccttcctctgacctcctgtattgaatgtgtcagttggcttttctggaaagcggatgctaaaatggaactaggggtgtaagaggcttattggaaggtaacacctgtgaaagatgaaaggcacaggaagcaggactggaaaggaaaggctcagaccacaatgcacatctgacaagttcccagtcaactcaacagcaagctagagaacaaggactgatgattagaagggctctgcattgcaaagaatggccaggcccaagtatctcggctgagctttgtcactggctggggatatctgggaaaagcatggagtagggcgactgtggtttacaataatctattgttatattttaaaatagctagaagaaaataatttgaatgtttctagcataaagaaaatttttaagatgatggacatcccaataacactgatttgatctttacaaattatatgaatgtattaaattatcacatatatgcccaaaatatgtacatctattatgtatcaataaaaaataaaattaaataaaaaggctgaggcaggtcctacaggcactaaaagttggaggctgtcagccaactacattcctcatggctgaatatcaaggtctttcttgaagggagatcagagaga

SEQ ID NO: 464993 - DNA, 715 bp, Homo sapiens
aatccaaggttcccttctaagggccaggtgagttcctggcaccattatacatatgaacttgtgaagatcatctactaaattcaccacatttgtagtcccgctgaaagtcttataaccagataaaatcctggaacttaagtatgagaacccttcatatactctcgtgccgaattcggcacgagcttcgtgaagcattcctgaagaccccagcctgacagatctccccttcctctgacctcctgtattggtaatgtattgtctacacctttcttagaacccctcattttctcccgtgaattctagtttattttcatatctgtctcactattttcaaagctaggtttgtactatgtaatataggtggctattagtatccattggtttcacatctgcagattcaaccaaccatgaattcaaccaactgtgaattcaaccagtggctgattataactgtttggaaaaaggccaggtgcagtggcttataccatgatctcaggactttgggaggctgaggtgggaggactgcttgagctcaggcgtttgagaccagcctgggcaacatggcaagacctaatctctacaaaaaatgcaaaaattaggcaggcatagtggtgcgttcctgtaatctcagctattcgggaggctgaggcaggaggatcacttgagcccagaaggtcaacactccagcctgggtgacaaagcaagattctgtctc

SEQ ID NO: 464994 - DNA, 1335 bp, Homo sapiens
  misc_feature (1201)..(1203): n is a, c, g, or t
  misc_feature (1206)..(1206): n is a, c, g, or t
  misc_feature (1211)..(1211): n is a, c, g, or t
  misc_feature (1216)..(1216): n is a, c, g, or t
  misc_feature (1258)..(1258): n is a, c, g, or t
  misc_feature (1284)..(1284): n is a, c, g, or t
  misc_feature (1296)..(1296): n is a, c, g, or t
gtggagctgtaggagctggagatggcatttcgtttggtgctcgagctcgtccaggatgtctgggatgtgtggttatatctgatttctgagctctgggcgtggaggtctgtctgcagaggcccgggcctgggcacaaagggagaggggcctccattgtcccgcaggggccaaaatgcagaccgcatccctgccccgctctccttgagggccctcaacactatcttccctggacacaagtctggggacagccgggtgtttgtagtggctgagctgggggatgccctggaactcagagcacacagcactggcttactgtggtacctgtgcagtgaagttgaagacagaatcaccaggatggaacacaggtcttgcaggatcacggaaaaccttcttagagttgtcttgacaccactgatgtcgagtgtgcgggtgtttgtaggatggcctgccactcagcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagggctggtgaatnnncanatctncgtcnagtgcagtaaccagttcaagttggaagtgtgtcttttgaatncagaaaacaaagtcgtggacaaccangctgggacccangggcagctgaaggtgctgggtgccaaacctctggtggcc

SEQ ID NO: 464995 - DNA, 1295 bp, Homo sapiens
  misc_feature (1027)..(1027): n is a, c, g, or t
gtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccaggtaagcggtgttgaactttctgcttgtgtattctctctgggcagagatgccacttgcctcccccaccatgccatctctgaagaatattacagaccattttggagcatggtgaataagaaattttcaccttaggagttcagttgaatagtcatttttatatttgtgactgcaagtcactcttaggggctgtacttccttagtactggtagcattattatccaatggacttttatagctttcattaggttttcttttgtttttgttctttaaagaacgttttacttatcttagtatttcatttttcatctatattatgaggcagtaagagtcttctgtttttccaaagttgagactgctttatatttatttcgtattgtctacagctgtagtgttcaatacattagccactagccacatgtggttatttaaataagataaaataaaaattggccgggcgtggtggntcacgccggtaatcccagcactttgggaggccgaggcgggcagatcattaggtcaggagatcgagaccatccttactaagacggtgaacccccatctctattaaaaatacaaaaaattagccgggcgtggtggcgggcgcctgcagtcccagctactcaggaggctgaggcaggagaatggcgtgaacctgggaggcagagtttgcagtgagccgagatggcgccactgcactccagcctggggacagagcgagactccatctcaaaa

SEQ ID NO: 464996 - DNA, 1081 bp, Homo sapiens
aaataagaaagaaaaatgaggtaactactgctatcaaaataccttcaaggcaataaaattagatagaagtattcattttgttttatttttgtttttaccactatacaaatgagcaggaagcattcattttaaaatctgtatgtgttcatattcatttctaaaaaaaaaaactcttactaattacatagtgaaaacacaaatttcttcttgcaattaaacatttctcaagagtttgatgggtaaaaaaaattaagtttaaagattcatagaaaagaaatatttcttcgtaaaattttagaacagatatttttctgaaagcttccagcacaggaaaaaaaaaaattttgtttgcagtaaaaggattgacaagcagaaaggcatggaacttctcgacagcacattaggaaccagtagaaatgtagcagtgcctctacaatttagaattaaaatgacttccaacctataattctacacctagctaaactatcaaataagtgtgagaatacaggaaaaacatatatctagatagatctatatgtctgtatatgcattatatgcaactaaaagtgtgtatttcttatgcagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaagcatagtggtgcatgcctgtagtcccagctacttgggatgctgaggcaggaagaattgcttgaacctgggaggcagagtctacagtgagccgagatcatgccactgcactccagcctgggtgacagagccagactccgtctca

SEQ ID NO: 464997 - DNA, 901 bp, Homo sapiens
gtgaaagagcaggttctgcttctttggtgtagtcctgaagcttcctaagaaacttcacatcaggtgatggataggagcaaccctgtaaaaccagccttagactatttttcaaacagatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaagcatagtggtgcatgcctgtagtcccagctacttgggatgctgaggcaggaagaattgcttgaacctgggaggcagagtctacagtgagccgagatcatgccactgcactccagcctgggtgacagagccagactccgtctca

SEQ ID NO: 464998 - DNA, 1089 bp, Homo sapiens
gtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaagcatagtggtgcatgcctgtagtcccagctacttgggatgctgaggcaggaagaattgcttgaacctgggaggcagagtctacagtgagccgagatcatgccactgcactccagcctgggtgacagagccagactccgtctca

SEQ ID NO: 464999 - DNA, 1331 bp, Homo sapiens
  misc_feature (1278)..(1278): n is a, c, g, or t
tgctgacgttattttccagagggcacaggaagaactagggaaactactcctgtcaatacttgccctcgtgtgtgatgttctcctccctgtatcccagcggattaagatgctcatttcttaaaattcaggggaaagatggacactaccggttccgtggcccagggttttggaagaggcggcctccggatgactggatgcacttctccctgggactcaccctgtgtcgttacagctcgagcttactgaaaataacagacagacacctccacttgtcccctccaacagagtggctgcactggcagctctctaatgaattaaaggagtgtgtttggctgacgagaggaccccatgcttgcatgtatggagccttatctcagcttccatacctacaaaggggacatgattggtgtctaccccagagagtggttttaagaattaaacaaaatgacgtgtgtgaaactcttggaacagtgtctggttcatggcaggaggtgtccgtgacgtgcctgaggccatttgtgtgcttacctgtgtgtttctgtaaagcagacccagtgcagggcaccagggatgtggtgggagccacacgggatgatgacgttcctaccctcagggagctcacacttacgagggggcagtagagtcatgttccaaactgaagttatgtgcttctttgatcatgggctgtatctgctttctttggtgtccttttcagttgcccactggaagagtctttccatttgccacactggatgccacactggatgggataatctaggagggaggaactgtggagatggtgcgccttgggatgtccagaagacagtgaccagaatttcaagagatgttttcagatttcacagtataataagagaaaaggagccaatcccttaaatgaagaaccttcaatcacttctccccaggtgcacgtttcaatttcatttcttttcatcaactccttccctttgatgatgggttgcattgaaaactattaagaaaagtaggatatttaaaatgaactgtgttaagaagaggatcatttcaaagaatctattctgaggaagtgccttcagccaatcaaaaagctaaagaaactggatataatgtgaatctagtgtaaattaccatgatgtctccttcaacattcatcaagacttctgactagtctacttgatctgtgaaaatgagattacttgaagacctgtcacagattttaaagcagaacacgatatattgattatacaaatatttttatgtcaccctgtatcttaataaaancctatgcggccaggggtccgcccccttgttactgatttaatcgcgattctaaa

SEQ ID NO: 465000 - DNA, 3113 bp, Homo sapiens
ctctacagcagcaatacgaggacatcctaaggagggcgaaggagagacagacggcgctggagaatctgctggcccactggcagagcctgtcccgaatgacttgcattttgcaagaatgcgaatcctttggacaacagccgcctgtgccgcatggtccttacttttcagtcctgttaggatgagatcctctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagagtgttgaagccctcaaaatcatctttggagaaaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagcctctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggtacatgcgacaccagccagacactgacaactgctgaatgctaatttgattagattcacaagtgcttgtgttgtgtcctaattgttctgtaagcctctaaatgaggattgtgtgggcaaaatggagaaattgggcaaaaaaggatacagaggcatcatttttcccctttgtaagaggaaaatgttattttaatagctttaaataattttaaatttgatttagtaaatattcagcaagc

SEQ ID NO: 465001 - DNA, 1883 bp, Homo sapiens
ctctacagcagcaatacgaggacatcctaaggagggcgaaggagagacagacggcgctggagaatctgctggcccactggcagagcctgtcccgaatgacttgcattttgcaagaatgcgaatcctttggacaacagccgcctgtgccgcatggtccttacttttcagtcctgttaggatgagatcctctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagagtgttgaagccctcaaaatcatctttggagaaaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacctgtgaaagtaggtccggctcattct

SEQ ID NO: 465002 - DNA, 10373 bp, Homo sapiens
aacctaacaaaccaggaagggtttgcacaaatgaaggagcggccaaagccagccatctcggaagggatgagagaccagttatcagaccaggatgaagagggaaagatcaagcaggagtatatcatatctgacccctccttttccatggtgacagtccaaagggaagatagtgggataacctgggaaaccaattcaagtagatcttctactccttgggcttcagaagaaagtcagacttctggtgtgtgtagtcgggaagggtcaactgtgaattctcctcctggaaatgtttcctttattgtggatgaagtgaaaaaggttcggaaaaggactcataagtcaaagcatggttcaccatcattacgccggaaaggcaacagaaaaagaaattcttttgaatcccaagatgttccaacaaacaaaaaaggcagtcctttaacttcagcaagccaggtactaaccacggagaaagagaagtcatatactggcatttatgataaagcaagaaaaaagaagaccacttcaaatacacctccgattactggggcaatatacaaagaacacaagccattagtgttaagaccagtctacataggaacagtacaatataaaattaagatgtttaattcggttaaagaagaattaattcctctacaattttatggaacattgccaaagggttatgtaattaaagaaatacattataggaaagggaaagatgcatccattagtctagagccagatttggacaatagtggttctaatacagtgtccaaaacacgcaaattagtagcccaaagcatagaggataaagtaaaagaggtttttccaccctggagaggcgcactctccaaaggatcagagtccctaaccttaatgttcagtcatgaagatcaaaagaaaatttatgctgattctcccctaaatgccacatctgcattggagcacacagttccctcttattcaagtagtggcagagcagaacaaggaatacagctcaggcattcacagtcagtgccacaacagccagaagatgaagcaaaaccacatgaagtggaacctccatctgtgacacccgacacacctgcaactatgttcctgagaacaacaaaggaagaatgtgagcttgcttcaccaggaactgcagcttcagagaatgactcttcagtctcaccatcatttgctaatgaggtaaagaaggaagatgtgtattctgctcaccattccatttctctggaggcagcgtcaccaggtctggcagcatctacccaggatggtttggacccagaccaagaacagccggacctgacttcaatagaaagggcagaaccagtctccgcaaaactgacccctacccatcccagtgtcaaaggagagaaggaggaaaacatgcttgagccatccatttctctttctgaacctctaatgttagaagaaccagagaaagaagaaatagaaacttccctacccatagctattacccctgaacctgaagattctaatttagtagaagaagagatcgtagaacttgattacccagaaagcccattggtttccgagaagcccttcccaccacatatgtcccctgaagtggagcacaaagaagaagagcttattctaccattattggcagcatcatctcctgaacatgttgctttgtctgaggaagaaagagaggaaattgcatctgtttctactggttctgcttttgtatcagagtattcagtaccacaggatttgaaccatgaattacaggagcaagaaggtgagccagttcccccatccaatgtagaagctatagctgaacatgcagttttgtcagaagaagagaatgaggaatttgaggcttattccccagctgcagcccctacatctgagagctctctctcaccatccacaactgagaagacttcagagaaccagtctccactgttttcaacagttacaccagaatacatggtcctatcaggagacgaggcctcagaaagtgggtgttacacaccagactccacatctgcttctgaatattcagttccatcactggcaacaaaagagtcactgaagaaaacaattgaccgtaagtccccgttaatattgaaaggtgtttctgagtacatgattccatcagaagagaaggaagacactggatcgtttactccagctgtggcccctgcttctgagccctctctctcaccatccacaaccgaaaagacttctgaatgccagtcaccactgccttctactgccacatcagaacacgtggtcccatcagaaggagaggacctaggaagtgaacgtttcacaccggattcaaagttgatctccaaatatgcagccccactcaatgcaacacaggaatctcaaaagaaaataatcaatgaggcatcccaattcaaaccaaaaggtatttctgagcacacagttctgtcagtagacggcaaggaggtcattggaccatcttccccagatttggttgttgcatctgaacactctttcccaccacacacaaccgagatgacttctgaatgccaggccccaccactttcagccaccccatctgaatatgttgttctatcgacgaagaggcaatctctaaatctaaaaggtgcatcctcacccatgaatttatcagaagaagatcaagaagacattggacctttttctccagattctgcatttgtgtcagaattctcatttccaccgtatgcaacccaggaagcagagaaaagagaatttgagtgcgattctccaatatgtttaacatcaccatctgagcacactattttgtcagatgaagacactgaagaagcggaactgttctctccagactcagcatcacaagtttcaatccctccctttagaatctcagaaacagagaaaaatgaacttgagcctgattcactattaactgcagtgtctgcttcaggttattcctgcttttcagaagcagatgaggaagacattggatccacagctgctacacctgtatctgagcagttcagttcatcacagaagcaaaaagctgaaactttccctttgatgtctccgcttgaagacttaagtctgccgccttcaacagataaatcagagaaagcagaaattaagccagagattccaacaacctcaacatctgtatctgaatatctcattttggcacagaagcagaaaactcaagcatatttagagcctgagtctgaagacttgattccttcacatttaaccagtgaagtggagaagggagaaagggaggcaagttcatcagtagctgcaatacctgctgctttacctgcacaatcatctatagtaaaggaagaaaccaaacctgcatctccacattcagttttacctgattcagtccctgcaatcaagaaagaacaggaacccacagcagcactcactctaaaagctgcagatgaacagatggctttgtcaaaagtcagaaaggaagaaattgtgcctgattctcaagaagctacagcacatgtatcacaggatcaaaaaatggagcctcagcctccaaatgttccagagtctgagatgaaatattcagttttgcctgacatggtagatgagccaaagaagggtgtcaagcccaaattagttctaaatgtgacttctgaactagaacagagaaagttgtccaagaatgagcctgaagtaataaaaccatattcacctctaaaggaaacatctttatctggacctgaggttttatcagcagtgaaaatggagatgaaacatgattccaaaataacaactacacctatagtgcttcattcagcttcctcaggagtggaaaagcaagttgaacatggtccacctgcactagcattttcagctttgtcagaagaaattaaaaaagaaattgaacccaaagtagaagccaaagaagttaaagctgggttgccagtaatcaaaacatcatcttctcagcattcagataaatctgaggaagcaagggtagaagacaaacaagatcttgtattttctacagtctgtgactctgaacgtttggtttcatcacagaagaagagcttgatgtctacctcagaggtgttagagcctgaacatgagcttccactcagcctatggggtgagataaagaagaaagaaactgaacttccttcatcacaaaatgtgtcacctgcatccaaacatataatcccaaaaggcaaagatgaggaaacagcaagttcatctcctgagttggaaaatttagcatcaggtttagccccaacattactgctcctcagtgatgataagaacaaaccggcagtggaggtatcttctacagctcagggagacttcccatcagaaaaacaagatgttgctttggcagagctgtctttggaacctgagaagaaagacaagccacaccaaccgttggaattaccaaatgctgggtcagaattttctagtgatttaggtagacaaagtggatccataggtacaaaacaagcaaagtctcccataactgaaacagaggattctgtttcagaaaaaggcccagctgagcttaggagcagagaaggaaaagaagaaaatagagagctttgtgcatcttctacgatgcctgcaatttcagagctttcatcattgcttagggaggaatctcagaatgaagaaattaaacctttctctcccaagatcatcagcctagagtcgaaagaaccacctgcctctgtagctgaaggaggcaacccagaagaatttcagccatttactttttctttaaaaggattatcagaggaggttagccatccagccgactttaaaaagggaggaaatcaagaaataggcccattaccaccaactggaaatttgaaggcacaagtcatgggagatattttagataagctaagtgaagaaacaggccacccaaattcatcccaggtactccagagtataacagaaccatcaaagattgctccttctgacctccttgtggaacaaaaaaagacagaaaaagcacttcattcagatcaaactgttaaattacctgatgtaagcacctcttctgaagataaacaagatctgggtattaagcagttttcacttatgagagagaatttgcctttggaacaatcaaaatcatttatgacaaccaagcctgcggatgtcaaagaaacaaaaatggaagaattctttatttctccaaaggatgaaaactggatgttgggaaagccagaaaatgtggctagtcaacacgaacagagaatagcaggatctgtgcagctggattcctctagcagcaatgagctgaggccagggcagctcaaggctgctgtgtccagtaaggaccatacatgtgaagtgagaaagcaggtcctgccgcattctgctgaagaatctcatttgtcatcacaagaagcagtatctgctcttgatacttccagtggtaatacagagaccttatcaagtaaaagttactcttctgaagaagtaaagctggctgaagaaccaaagtctttagtcctagctggaaatgtagagagaaacatagcagaggggaaggagattcattctttgatggagagtgaaagtttgctattggagaaagcaaacacagagctttcctggccttccaaagaagatagccaggaaaaaattaaactacctcctgaaagattcttccagaaaccagtgtctggcctatcagtggaacaggtgaagtcagaaacaatctcctcttctgtcaaaacagcccatttcccggcagaaggtgtggaacctgcattgggcaatgaaaaagaagcacacaggagcacacctccttttcctgaagagaagccattggaagaatcaaaaatggttcagtcaaaggttattgatgatgctgatgagggaaagaaaccatcacctgaagtaaaaatacccacacaaagaaaacccatctcctcaatccatgcaagagagcctcaatccccagagtcacctgaggtgacacaaaatccacctacacaaccaaaggtggctaagccggaccttcctgaggaaaagggaaagaaaggaatttcatctttcaaatcgtggatgtccagcttgttttttggatcgagcactccagataacaaagttgctgaacaagaagacttagaaacacagccaagtccatccgtagaaaaagcagtgactgtgatagatcctgaaggtacaattcccaccaattttaatgtagctgagaaaccagctgatcattcattatcagaggtaaaacttaaaactgctgatgaacccagaggtactttagtaaaatctggtgacggtcaaaacgttaaagaaaaatccatgattttatcaaatgtagaagatttacaacagccaaaattcatttctgaggtgtctagggaagattatggaaaaaaagaaatctcaggcgattcagaggaaatgaacataaactcagtagttacttctgctgatggtgagaaccttgaaattcaatcttattcactaatcggtgagaaattggttatggaagaagccaaaactattgttcctcctcatgttactgatagtaaaagagtccagaagccagcaatcgctcctccatctaaatggaatatttctatttttaaggaagagccaagaagtgatcaaaaacaaaaatcactcctttcatttgatgtagtagataaggtgccacaacagccaaaatcagcttcctccaactttgcaagtaaaaatatcacaaaggaatcagagaaaccagagtcaattattttgccagtagaagaatcaaaaggcagtttaattgatttcagtgaagacagactcaagaaagaaatgcaaaatcctacttccttgaaaatttctgaagaggaaacaaaactcaggtctgttagtccaactgagaagaaagataatttggaaaacagatcatataccttggcagaaaagaaggtgctggcagaaaaacaaaactctgtggccccattagagcttagagatagtaatgaaatagggaagacacaaattacacttggatctagatctactgaactgaaagaatcaaaagccgatgctatgccacagcacttctatcaaaatgaagactacaatgaaagacccaaaatcattgttggttctgaaaaggagaaaggtgaagaaaaagaaaatcaggtatatgtgctttcagaaggaaagaagcagcaggaacatcagccttattctgtgaatgtagccgagtctatgagtagagaatcagatatctctttaggtcattctttggatgaaactcaatcattttcattagttaaagctacatcagttactgaaaaatcagaagccatgctcgcagaggctcacccagaaatcagagaagcaaaggcagtaggaacccaaccacatcctttagaagaaagtaaagttttggtggagaaaaccaagactttcctgccggtggctctttcttgtcgtgatgaaatagagaaccactctttatctcaggaaggaaatctagtattagaaaagtcaagcagagatatgccagatcacagtgaagaaaaagaacagttcagagagtcagagctatcgaaaggcggttcagtagatatcacaaaagaaactgtgaaacaaggatttcaagaaaaggcagtaggaacccaaccacgtcctttagaagaaagtaaagttttggtggagaaaactaagactttcctgccagtggttctttcttgtcatgatgaaatagagaaccactctttgtctcaggaaggaaatctagtgttagaaaagtcaagcagagatatgccagatcacagtgaagaaaaagaacagttcaaagagtcagagctatggaaaggtggttcagtagatatcacaaaagaaagtatgaaagaaggatttccatctaaagaatccgaaaggactttagctcgtccttttgatgaaactaagagctcagaaacaccgccatatttgctgtcacctgtaaaaccacaaactcttgcttcaggagcttctccagaaattaacgcagtgaagaaaaaagaaatgccacgatcagaattgactccagaaaggcatacagttcatactattcagacatctaaagatgacacatccgatgtgcctaaacaatctgttcttgtttcaaagcaccacttggaggctgcggaagatacccgtgtaaaggaaccactgtcttcagcaaaaagcaactatgctcaatttatatctaatacatcagcaagcaatgctgataaaatggtttctaataaagaaatgcccaaggaacctgaagacacatatgcaaaaggtgaagactttacagtgactagtaagccagccggactttcagaagatcagaagactgcctttagtatcatttctgaaggctgtgagatattgaatattcatgctccggcctttatttcttcaatcgatcaggaagaaagtgaacaaatgcaagataaattagaatatttggaagagaaagcctcatttaaaaccataccactccctgatgatagtgaaacagttgcttgtcataaaacattaaagagcaggttagaagatgaaaaagttaccccattgaaagaaaataaacaaaaggaaactcataagacaaaagaagagatatccacagattcagaaactgatttatcatttattcagcccacaattcccagtgaagaggattattttgaaaaatatactttgattgattataacatctccccagacccagaaaaacagaaagctccacagaaattaaatgttgaagagaaactctcaaaggaagttacagaagaaactatctctttcccagtaagttcagtggaaagtgcactagaacatgaatatgacttggtgaaattagatgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggtaaatagatgttgaacacacataattaataatatatatatacacatttaatttgcttttacattttctcaattttaaagatgattaatatttgatcattgatctttaagcagaatggtctgaaagcaaactaagaatatttctccaagaatttagttaaggtaggcttgacagacattcattgagtacagcccaccctccttatccttgagttctgcatgcttagaatcaaccaaccgcagatc

SEQ ID NO: 465003 - DNA, 6159 bp, Homo sapiens
  misc_feature (6156)..(6156): n is a, c, g, or t
aacctaacaaaccaggaagggtttgcacaaatgaaggagcggccaaagccagccatctcggaagggatgagagaccagttatcagaccaggatgaagagggaaagatcaagcaggagtatatcatatctgacccctccttttccatggtgacagtccaaagggaagatagtgggataacctgggaaaccaattcaagtagatcttctactccttgggcttcagaagaaagtcagacttctggtgtgtgtagtcgggaagggtcaactgtgaattctcctcctggaaatgtttcctttattgtggatgaagtgaaaaaggttcggaaaaggactcataagtcaaagcatggttcaccatcattacgccggaaaggcaacagaaaaagaaattcttttgaatcccaagatgttccaacaaacaaaaaaggcagtcctttaacttcagcaagccaggtactaaccacggagaaagagaagtcatatactggcatttatgataaagcaagaaaaaagaagaccacttcaaatacacctccgattactggggcaatatacaaagaacacaagccattagtgttaagaccagtctacataggaacagtacaatataaaattaagatgtttaattcggttaaagaagaattaattcctctacaattttatggaacattgccaaagggttatgtaattaaagaaatacattataggaaagggaaagatgcatccattagtctagagccagatttggacaatagtggttctaatacagtgtccaaaacacgcaaattagtagcccaaagcatagaggataaagtaaaagaggtttttccaccctggagaggcgcactctccaaaggatcagagtccctaaccttaatgttcagtcatgaagatcaaaagaaaatttatgctgattctcccctaaatgccacatctgcattggagcacacagttccctcttattcaagtagtggcagagcagaacaaggaatacagctcaggcattcacagtcagtgccacaacagccagaagatgaagcaaaaccacatgaagtggaacctccatctgtgacacccgacacacctgcaactatgttcctgagaacaacaaaggaagaatgtgagcttgcttcaccaggaactgcagcttcagagaatgactcttcagtctcaccatcatttgctaatgaggtaaagaaggaagatgtgtattctgctcaccattccatttctctggaggcagcgtcaccaggtctggcagcatctacccaggatggtttggacccagaccaagaacagccggacctgacttcaatagaaagggcagaaccagtctccgcaaaactgacccctacccatcccagtgtcaaaggagagaaggaggaaaacatgcttgagccatccatttctctttctgaacctctaatgttagaagaaccagagaaagaagaaatagaaacttccctacccatagctattacccctgaacctgaagattctaatttagtagaagaagagatcgtagaacttgattacccagaaagcccattggtttccgagaagcccttcccaccacatatgtcccctgaagtggagcacaaagaagaagagcttattctaccattattggcagcatcatctcctgaacatgttgctttgtctgaggaagaaagagaggaaattgcatctgtttctactggttctgcttttgtatcagagtattcagtaccacaggatttgaaccatgaattacaggagcaagaaggtgagccagttcccccatccaatgtagaagctatagctgaacatgcagttttgtcagaagaagagaatgaggaatttgaggcttattccccagctgcagcccctacatctgagagctctctctcaccatccacaactgagaagacttcagagaaccagtctccactgttttcaacagttacaccagaatacatggtcctatcaggagacgaggcctcagaaagtgggtgttacacaccagactccacatctgcttctgaatattcagttccatcactggcaacaaaagagtcactgaagaaaacaattgaccgtaagtccccgttaatattgaaaggtgtttctgagtacatgattccatcagaagagaaggaagacactggatcgtttactccagctgtggcccctgcttctgagccctctctctcaccatccacaaccgaaaagacttctgaatgccagtcaccactgccttctactgccacatcagaacacgtggtcccatcagaaggagaggacctaggaagtgaacgtttcacaccggattcaaagttgatctccaaatatgcagccccactcaatgcaacacaggaatctcaaaagaaaataatcaatgaggcatcccaattcaaaccaaaaggtatttctgagcacacagttctgtcagtagacggcaaggaggtcattggaccatcttccccagatttggttgttgcatctgaacactctttcccaccacacacaaccgagatgacttctgaatgccaggccccaccactttcagccaccccatctgaatatgttgttctatcgacgaagaggcaatctctaaatctaaaaggtgcatcctcacccatgaatttatcagaagaagatcaagaagacattggacctttttctccagattctgcatttgtgtcagaattctcatttccaccgtatgcaacccaggaagcagagaaaagagaatttgagtgcgattctccaatatgtttaacatcaccatctgagcacactattttgtcagatgaagacactgaagaagcggaactgttctctccagactcagcatcacaagtttcaatccctccctttagaatctcagaaacagagaaaaatgaacttgagcctgattcactattaactgcagtgtctgcttcaggttattcctgcttttcagaagcagatgaggaagacattggatccacagctgctacacctgtatctgagcagttcagttcatcacagaagcaaaaagctgaaactttccctttgatgtctccgcttgaagacttaagtctgccgccttcaacagataaatcagagaaagcagaaattaagccagagattccaacaacctcaacatctgtatctgaatatctcattttggcacagaagcagaaaactcaagcatatttagagcctgagtctgaagacttgattccttcacatttaaccagtgaagtggagaagggagaaagggaggcaagttcatcagtagctgcaatacctgctgctttacctgcacaatcatctatagtaaaggaagaaaccaaacctgcatctccacattcagttttacctgattcagtccctgcaatcaagaaagaacaggaacccacagcagcactcactctaaaagctgcagatgaacagatggctttgtcaaaagtcagaaaggaagaaattgtgcctgattctcaagaagctacagcacatgtatcacaggatcaaaaaatggagcctcagcctccaaatgttccagagtctgagatgaaatattcagttttgcctgacatggtagatgagccaaagaagggtgtcaagcccaaattagttctaaatgtgacttctgaactagaacagagaaagttgtccaagaatgagcctgaagtaataaaaccatattcacctctaaaggaaacatctttatctggacctgaggttttatcagcagtgaaaatggagatgaaacatgattccaaaataacaactacacctatagtgcttcattcagcttcctcaggagtggaaaagcaagttgaacatggtccacctgcactagcattttcagctttgtcagaagaaattaaaaaagaaattgaacccaaagtagaagccaaagaagttaaagctgggttgccagtaatcaaaacatcatcttctcagcattcagataaatctgaggaagcaagggtagaagacaaacaagatcttgtattttctacagtctgtgactctgaacgtttggtttcatcacagaagaagagcttgatgtctacctcagaggtgttagagcctgaacatgagcttccactcagcctatggggtgagataaagaagaaagaaactgaacttccttcatcacaaaatgtgtcacctgcatccaaacatataatcccaaaaggcaaagatgaggaaacagcaagttcatctcctgagttggaaaatttagcatcaggtttagccccaacattactgctcctcagtgatgataagaacaaaccggcagtggaggtatcttctacagctcagggagacttcccatcagaaaaacaagatgttgctttggcagagctgtctttggaacctgagaagaaagacaagccacaccaaccgttggaattaccaaatgctgggtcagaattttctagtgatttaggtagacaaagtggatccataggtacaaaacaagcaaagtctcccataactgaaacagaggattctgtttcagaaaaaggcccagctgagcttaggagcagagaaggaaaagaagaaaatagagagctttgtgcatcttctacgatgcctgcaatttcagagctttcatcattgcttagggaggaatctcagaatgaagaaattaaacctttctctcccaagatcatcagcctagagtcgaaagaaccacctgcctctgtagctgaaggaggcaacccagaagaatttcagccatttactttttctttaaaaggattatcagaggaggttagccatccagccgactttaaaaagggaggaaatcaagaaataggcccattaccaccaactggaaatttgaaggcacaagtcatgggagatattttagataagctaagtgaagaaacaggccacccaaattcatcccaggtactccagagtataacagaaccatcaaagattgctccttctgacctccttgtggaacaaaaaaagacagaaaaagcacttcattcagatcaaactgttaaattacctgatgtaagcacctcttctgaagataaacaagatctgggtattaagcagttttcacttatgagagagaatttgcctttggaacaatcaaaatcatttatgacaaccaagcctgcggatgtcaaagaaacaaaaatggaagaattctttatttctccaaaggatgaaaactggatgttgggaaagccagaaaatgtggctagtcaacacgaacagagaatagcaggatctgtgcagctggattcctctagcagcaatgagctgaggccagggcagctcaaggctgctgtgtccagtaaggaccatacatgtgaagtgagaaagcaggtcctgccgcattctgctgaagaatctcatttgtcatcacaagaagcagtatctgctcttgatacttccagtggtaatacagagaccttatcaagtaaaagttactcttctgaagaagtaaagctggctgaagaaccaaagtctttagtcctagctggaaatgtagagagaaacatagcagaggggaaggagattcattctttgatggagagtgaaagtttgctattggagaaagcaaacacagagctttcctggccttccaaagaagatagccaggaaaaaattaaactacctcctgaaagattcttccagaaaccagtgtctggcctatcagtggaacaggtgaagtcagaaacaatctcctcttctgtcaaaacagcccatttcccggcagaaggtgtggaacctgcattgggcaatgaaaaagaagcacacaggagcacacctccttttcctgaagagaagccattggaagaatcaaaaatggttcagtcaaaggttattgatgatgctgatgagggaaagaaaccatcacctgaagtaaaaatacccacacaaagaaaacccatctcctcaatccatgcaagagagcctcaatccaaagattcatctcttatatctgtagatcgtcagtctacaaagtggaaggggttggagtggttggcccctgttactttgggttgaattagttgggaaaaagtggtaggggttctgaaatttcaattgtgggggaaggaaatggattagggctataaatgttggagaaaatatgggtgaatggtgggggggagcattgggggggaggaggtctaagaacatatatgttgttantgg

SEQ ID NO: 465004 - DNA, 10343 bp, Homo sapiens
aacctaacaaaccaggaagggtttgcacaaatgaaggagcggccaaagccagccatctcggaagggatgagagaccagttatcagaccaggatgaagagggaaagatcaagcaggagtatatcatatctgacccctccttttccatggtgacagtccaaagggaagatagtgggataacctgggaaaccaattcaagtagatcttctactccttgggcttcagaagaaagtcagacttctggtgtgtgtagtcgggaagggtcaactgtgaattctcctcctggaaatgtttcctttattgtggatgaagtgaaaaaggttcggaaaaggactcataagtcaaagcatggttcaccatcattacgccggaaaggcaacagaaaaagaaattcttttgaatcccaagatgttccaacaaacaaaaaaggcagtcctttaacttcagcaagccaggtactaaccacggagaaagagaagtcatatactggcatttatgataaagcaagaaaaaagaagaccacttcaaatacacctccgattactggggcaatatacaaagaacacaagccattagtgttaagaccagtctacataggaacagtacaatataaaattaagatgtttaattcggttaaagaagaattaattcctctacaattttatggaacattgccaaagggttatgtaattaaagaaatacattataggaaagggaaagatgcatccattagtctagagccagatttggacaatagtggttctaatacagtgtccaaaacacgcaaattagtagcccaaagcatagaggataaagtaaaagaggtttttccaccctggagaggcgcactctccaaaggatcagagtccctaaccttaatgttcagtcatgaagatcaaaagaaaatttatgctgattctcccctaaatgccacatctgcattggagcacacagttccctcttattcaagtagtggcagagcagaacaaggaatacagctcaggcattcacagtcagtgccacaacagccagaagatgaagcaaaaccacatgaagtggaacctccatctgtgacacccgacacacctgcaactatgttcctgagaacaacaaaggaagaatgtgagcttgcttcaccaggaactgcagcttcagagaatgactcttcagtctcaccatcatttgctaatgaggtaaagaaggaagatgtgtattctgctcaccattccatttctctggaggcagcgtcaccaggtctggcagcatctacccaggatggtttggacccagaccaagaacagccggacctgacttcaatagaaagggcagaaccagtctccgcaaaactgacccctacccatcccagtgtcaaaggagagaaggaggaaaacatgcttgagccatccatttctctttctgaacctctaatgttagaagaaccagagaaagaagaaatagaaacttccctacccatagctattacccctgaacctgaagattctaatttagtagaagaagagatcgtagaacttgattacccagaaagcccattggtttccgagaagcccttcccaccacatatgtcccctgaagtggagcacaaagaagaagagcttattctaccattattggcagcatcatctcctgaacatgttgctttgtctgaggaagaaagagaggaaattgcatctgtttctactggttctgcttttgtatcagagtattcagtaccacaggatttgaaccatgaattacaggagcaagaaggtgagccagttcccccatccaatgtagaagctatagctgaacatgcagttttgtcagaagaagagaatgaggaatttgaggcttattccccagctgcagcccctacatctgagagctctctctcaccatccacaactgagaagacttcagagaaccagtctccactgttttcaacagttacaccagaatacatggtcctatcaggagacgaggcctcagaaagtgggtgttacacaccagactccacatctgcttctgaatattcagttccatcactggcaacaaaagagtcactgaagaaaacaattgaccgtaagtccccgttaatattgaaaggtgtttctgagtacatgattccatcagaagagaaggaagacactggatcgtttactccagctgtggcccctgcttctgagccctctctctcaccatccacaaccgaaaagacttctgaatgccagtcaccactgccttctactgccacatcagaacacgtggtcccatcagaaggagaggacctaggaagtgaacgtttcacaccggattcaaagttgatctccaaatatgcagccccactcaatgcaacacaggaatctcaaaagaaaataatcaatgaggcatcccaattcaaaccaaaaggtatttctgagcacacagttctgtcagtagacggcaaggaggtcattggaccatcttccccagatttggttgttgcatctgaacactctttcccaccacacacaaccgagatgacttctgaatgccaggccccaccactttcagccaccccatctgaatatgttgttctatcgacgaagaggcaatctctaaatctaaaaggtgcatcctcacccatgaatttatcagaagaagatcaagaagacattggacctttttctccagattctgcatttgtgtcagaattctcatttccaccgtatgcaacccaggaagcagagaaaagagaatttgagtgcgattctccaatatgtttaacatcaccatctgagcacactattttgtcagatgaagacactgaagaagcggaactgttctctccagactcagcatcacaagtttcaatccctccctttagaatctcagaaacagagaaaaatgaacttgagcctgattcactattaactgcagtgtctgcttcaggttattcctgcttttcagaagcagatgaggaagacattggatccacagctgctacacctgtatctgagcagttcagttcatcacagaagcaaaaagctgaaactttccctttgatgtctccgcttgaagacttaagtctgccgccttcaacagataaatcagagaaagcagaaattaagccagagattccaacaacctcaacatctgtatctgaatatctcattttggcacagaagcagaaaactcaagcatatttagagcctgagtctgaagacttgattccttcacatttaaccagtgaagtggagaagggagaaagggaggcaagttcatcagtagctgcaatacctgctgctttacctgcacaatcatctatagtaaaggaagaaaccaaacctgcatctccacattcagttttacctgattcagtccctgcaatcaagaaagaacaggaacccacagcagcactcactctaaaagctgcagatgaacagatggctttgtcaaaagtcagaaaggaagaaattgtgcctgattctcaagaagctacagcacatgtatcacaggatcaaaaaatggagcctcagcctccaaatgttccagagtctgagatgaaatattcagttttgcctgacatggtagatgagccaaagaagggtgtcaagcccaaattagttctaaatgtgacttctgaactagaacagagaaagttgtccaagaatgagcctgaagtaataaaaccatattcacctctaaaggaaacatctttatctggacctgaggttttatcagcagtgaaaatggagatgaaacatgattccaaaataacaactacacctatagtgcttcattcagcttcctcaggagtggaaaagcaagttgaacatggtccacctgcactagcattttcagctttgtcagaagaaattaaaaaagaaattgaacccaaagtagaagccaaagaagttaaagctgggttgccagtaatcaaaacatcatcttctcagcattcagataaatctgaggaagcaagggtagaagacaaacaagatcttgtattttctacagtctgtgactctgaacgtttggtttcatcacagaagaagagcttgatgtctacctcagaggtgttagagcctgaacatgagcttccactcagcctatggggtgagataaagaagaaagaaactgaacttccttcatcacaaaatgtgtcacctgcatccaaacatataatcccaaaaggcaaagatgaggaaacagcaagttcatctcctgagttggaaaatttagcatcaggtttagccccaacattactgctcctcagtgatgataagaacaaaccggcagtggaggtatcttctacagctcagggagacttcccatcagaaaaacaagatgttgctttggcagagctgtctttggaacctgagaagaaagacaagccacaccaaccgttggaattaccaaatgctgggtcagaattttctagtgatttaggtagacaaagtggatccataggtacaaaacaagcaaagtctcccataactgaaacagaggattctgtttcagaaaaaggcccagctgagcttaggagcagagaaggaaaagaagaaaatagagagctttgtgcatcttctacgatgcctgcaatttcagagctttcatcattgcttagggaggaatctcagaatgaagaaattaaacctttctctcccaagatcatcagcctagagtcgaaagaaccacctgcctctgtagctgaaggaggcaacccagaagaatttcagccatttactttttctttaaaaggattatcagaggaggttagccatccagccgactttaaaaagggaggaaatcaagaaataggcccattaccaccaactggaaatttgaaggcacaagtcatgggagatattttagataagctaagtgaagaaacaggccacccaaattcatcccaggtactccagagtataacagaaccatcaaagattgctccttctgacctccttgtggaacaaaaaaagacagaaaaagcacttcattcagatcaaactgttaaattacctgatgtaagcacctcttctgaagataaacaagatctgggtattaagcagttttcacttatgagagagaatttgcctttggaacaatcaaaatcatttatgacaaccaagcctgcggatgtcaaagaaacaaaaatggaagaattctttatttctccaaaggatgaaaactggatgttgggaaagccagaaaatgtggctagtcaacacgaacagagaatagcaggatctgtgcagctggattcctctagcagcaatgagctgaggccagggcagctcaaggctgctgtgtccagtaaggaccatacatgtgaagtgagaaagcaggtcctgccgcattctgctgaagaatctcatttgtcatcacaagaagcagtatctgctcttgatacttccagtggtaatacagagaccttatcaagtaaaagttactcttctgaagaagtaaagctggctgaagaaccaaagtctttagtcctagctggaaatgtagagagaaacatagcagaggggaaggagattcattctttgatggagagtgaaagtttgctattggagaaagcaaacacagagctttcctggccttccaaagaagatagccaggaaaaaattaaactacctcctgaaagattcttccagaaaccagtgtctggcctatcagtggaacaggtgaagtcagaaacaatctcctcttctgtcaaaacagcccatttcccggcagaaggtgtggaacctgcattgggcaatgaaaaagaagcacacaggagcacacctccttttcctgaagagaagccattggaagaatcaaaaatggttcagtcaaaggttattgatgatgctgatgagggaaagaaaccatcacctgaagtaaaaatacccacacaaagaaaacccatctcctcaatccatgcaagagagcctcaatccccagagtcacctgaggtgacacaaaatccacctacacaaccaaaggtggctaagccggaccttcctgaggaaaagggaaagaaaggaatttcatctttcaaatccactccagataacaaagttgctgaacaagaagacttagaaacacagccaagtccatccgtagaaaaagcagtgactgtgatagatcctgaaggtacaattcccaccaattttaatgtagctgagaaaccagctgatcattcattatcagaggtaaaacttaaaactgctgatgaacccagaggtactttagtaaaatctggtgacggtcaaaacgttaaagaaaaatccatgattttatcaaatgtagaagatttacaacagccaaaattcatttctgaggtgtctagggaagattatggaaaaaaagaaatctcaggcgattcagaggaaatgaacataaactcagtagttacttctgctgatggtgagaaccttgaaattcaatcttattcactaatcggtgagaaattggttatggaagaagccaaaactattgttcctcctcatgttactgatagtaaaagagtccagaagccagcaatcgctcctccatctaaatggaatatttctatttttaaggaagagccaagaagtgatcaaaaacaaaaatcactcctttcatttgatgtagtagataaggtgccacaacagccaaaatcagcttcctccaactttgcaagtaaaaatatcacaaaggaatcagagaaaccagagtcaattattttgccagtagaagaatcaaaaggcagtttaattgatttcagtgaagacagactcaagaaagaaatgcaaaatcctacttccttgaaaatttctgaagaggaaacaaaactcaggtctgttagtccaactgagaagaaagataatttggaaaacagatcatataccttggcagaaaagaaggtgctggcagaaaaacaaaactctgtggccccattagagcttagagatagtaatgaaatagggaagacacaaattacacttggatctagatctactgaactgaaagaatcaaaagccgatgctatgccacagcacttctatcaaaatgaagactacaatgaaagacccaaaatcattgttggttctgaaaaggagaaaggtgaagaaaaagaaaatcaggtatatgtgctttcagaaggaaagaagcagcaggaacatcagccttattctgtgaatgtagccgagtctatgagtagagaatcagatatctctttaggtcattctttggatgaaactcaatcattttcattagttaaagctacatcagttactgaaaaatcagaagccatgctcgcagaggctcacccagaaatcagagaagcaaaggcagtaggaacccaaccacatcctttagaagaaagtaaagttttggtggagaaaaccaagactttcctgccggtggctctttcttgtcgtgatgaaatagagaaccactctttatctcaggaaggaaatctagtattagaaaagtcaagcagagatatgccagatcacagtgaagaaaaagaacagttcagagagtcagagctatcgaaaggcggttcagtagatatcacaaaagaaactgtgaaacaaggatttcaagaaaaggcagtaggaacccaaccacgtcctttagaagaaagtaaagttttggtggagaaaactaagactttcctgccagtggttctttcttgtcatgatgaaatagagaaccactctttgtctcaggaaggaaatctagtgttagaaaagtcaagcagagatatgccagatcacagtgaagaaaaagaacagttcaaagagtcagagctatggaaaggtggttcagtagatatcacaaaagaaagtatgaaagaaggatttccatctaaagaatccgaaaggactttagctcgtccttttgatgaaactaagagctcagaaacaccgccatatttgctgtcacctgtaaaaccacaaactcttgcttcaggagcttctccagaaattaacgcagtgaagaaaaaagaaatgccacgatcagaattgactccagaaaggcatacagttcatactattcagacatctaaagatgacacatccgatgtgcctaaacaatctgttcttgtttcaaagcaccacttggaggctgcggaagatacccgtgtaaaggaaccactgtcttcagcaaaaagcaactatgctcaatttatatctaatacatcagcaagcaatgctgataaaatggtttctaataaagaaatgcccaaggaacctgaagacacatatgcaaaaggtgaagactttacagtgactagtaagccagccggactttcagaagatcagaagactgcctttagtatcatttctgaaggctgtgagatattgaatattcatgctccggcctttatttcttcaatcgatcaggaagaaagtgaacaaatgcaagataaattagaatatttggaagagaaagcctcatttaaaaccataccactccctgatgatagtgaaacagttgcttgtcataaaacattaaagagcaggttagaagatgaaaaagttaccccattgaaagaaaataaacaaaaggaaactcataagacaaaagaagagatatccacagattcagaaactgatttatcatttattcagcccacaattcccagtgaagaggattattttgaaaaatatactttgattgattataacatctccccagacccagaaaaacagaaagctccacagaaattaaatgttgaagagaaactctcaaaggaagttacagaagaaactatctctttcccagtaagttcagtggaaagtgcactagaacatgaatatgacttggtgaaattagatgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggtaaatagatgttgaacacacataattaataatatatatatacacatttaatttgcttttacattttctcaattttaaagatgattaatatttgatcattgatctttaagcagaatggtctgaaagcaaactaagaatatttctccaagaatttagttaaggtaggcttgacagacattcattgagtacagcccaccctccttatccttgagttctgcatgcttagaatcaaccaaccgcagatc

SEQ ID NO: 465005 - DNA, 5952 bp, Homo sapiens
catctgcagatgaacattcagttcttgcagaagaagacaaggtggcaattaaaggtgcttctcccattgaaacttcatccaaacatttagcttggtcagaggcagagaaggaaaagaagaaaatagagagctttgtgcatcttctacgatgcctgcaatttcagagctttcatcattgcttagggaggaatctcagaatgaagaaattaaacctttctctcccaagatcatcagcctagagtcgaaagaaccacctgcctctgtagctgaaggaggcaacccagaagaatttcagccatttactttttctttaaaaggattatcagaggaggttagccatccagccgactttaaaaagggaggaaatcaagaaataggcccattaccaccaactggaaatttgaaggcacaagtcatgggagatattttagataagctaagtgaagaaacaggccacccaaattcatcccaggtactccagagtataacagaaccatcaaagattgctccttctgacctccttgtggaacaaaaaaagacagaaaaagcacttcattcagatcaaactgttaaattacctgatgtaagcacctcttctgaagataaacaagatctgggtattaagcagttttcacttatgagagagaatttgcctttggaacaatcaaaatcatttatgacaaccaagcctgcggatgtcaaagaaacaaaaatggaagaattctttatttctccaaaggatgaaaactggatgttgggaaagccagaaaatgtggctagtcaacacgaacagagaatagcaggatctgtgcagctggattcctctagcagcaatgagctgaggccagggcagctcaaggctgctgtgtccagtaaggaccatacatgtgaagtgagaaagcaggtcctgccgcattctgctgaagaatctcatttgtcatcacaagaagcagtatctgctcttgatacttccagtggtaatacagagaccttatcaagtaaaagttactcttctgaagaagtaaagctggctgaagaaccaaagtctttagtcctagctggaaatgtagagagaaacatagcagaggggaaggagattcattctttgatggagagtgaaagtttgctattggagaaagcaaacacagagctttcctggccttccaaagaagatagccaggaaaaaattaaactacctcctgaaagattcttccagaaaccagtgtctggcctatcagtggaacaggtgaagtcagaaacaatctcctcttctgtcaaaacagcccatttcccggcagaaggtgtggaacctgcattgggcaatgaaaaagaagcacacaggagcacacctccttttcctgaagagaagccattggaagaatcaaaaatggttcagtcaaaggttattgatgatgctgatgagggaaagaaaccatcacctgaagtaaaaatacccacacaaagaaaacccatctcctcaatccatgcaagagagcctcaatccccagagtcacctgaggtgacacaaaatccacctacacaaccaaaggtggctaagccggaccttcctgaggaaaagggaaagaaaggaatttcatctttcaaatcgtggatgtccagcttgttttttggatcgagcactccagataacaaagttgctgaacaagaagacttagaaacacagccaagtccatccgtagaaaaagcagtgactgtgatagatcctgaaggtacaattcccaccaattttaatgtagctgagaaaccagctgatcattcattatcagaggtaaaacttaaaactgctgatgaacccagaggtactttagtaaaatctggtgacggtcaaaacgttaaagaaaaatccatgattttatcaaatgtagaagatttacaacagccaaaattcatttctgaggtgtctagggaagattatggaaaaaaagaaatctcaggcgattcagaggaaatgaacataaactcagtagttacttctgctgatggtgagaaccttgaaattcaatcttattcactaatcggtgagaaattggttatggaagaagccaaaactattgttcctcctcatgttactgatagtaaaagagtccagaagccagcaatcgctcctccatctaaatggaatatttctatttttaaggaagagccaagaagtgatcaaaaacaaaaatcactcctttcatttgatgtagtagataaggtgccacaacagccaaaatcagcttcctccaactttgcaagtaaaaatatcacaaaggaatcagagaaaccagagtcaattattttgccagtagaagaatcaaaaggcagtttaattgatttcagtgaagacagactcaagaaagaaatgcaaaatcctacttccttgaaaatttctgaagaggaaacaaaactcaggtctgttagtccaactgagaagaaagataatttggaaaacagatcatataccttggcagaaaagaaggtgctggcagaaaaacaaaactctgtggccccattagagcttagagatagtaatgaaatagggaagacacaaattacacttggatctagatctactgaactgaaagaatcaaaagccgatgctatgccacagcacttctatcaaaatgaagactacaatgaaagacccaaaatcattgttggttctgaaaaggagaaaggtgaagaaaaagaaaatcaggtatatgtgctttcagaaggaaagaagcagcaggaacatcagccttattctgtgaatgtagccgagtctatgagtagagaatcagatatctctttaggtcattctttggatgaaactcaatcattttcattagttaaagctacatcagttactgaaaaatcagaagccatgctcgcagaggctcacccagaaatcagagaagcaaaggcagtaggaacccaaccacatcctttagaagaaagtaaagttttggtggagaaaaccaagactttcctgccggtggctctttcttgtcgtgatgaaatagagaaccactctttatctcaggaaggaaatctagtattagaaaagtcaagcagagatatgccagatcacagtgaagaaaaagaacagttcagagagtcagagctatcgaaaggcggttcagtagatatcacaaaagaaactgtgaaacaaggatttcaagaaaaggcagtaggaacccaaccacgtcctttagaagaaagtaaagttttggtggagaaaactaagactttcctgccagtggttctttcttgtcatgatgaaatagagaaccactctttgtctcaggaaggaaatctagtgttagaaaagtcaagcagagatatgccagatcacagtgaagaaaaagaacagttcaaagagtcagagctatggaaaggtggttcagtagatatcacaaaagaaagtatgaaagaaggatttccatctaaagaatccgaaaggactttagctcgtccttttgatgaaactaagagctcagaaacaccgccatatttgctgtcacctgtaaaaccacaaactcttgcttcaggagcttctccagaaattaacgcagtgaagaaaaaagaaatgccacgatcagaattgactccagaaaggcatacagttcatactattcagacatctaaagatgacacatccgatgtgcctaaacaatctgttcttgtttcaaagcaccacttggaggctgcggaagatacccgtgtaaaggaaccactgtcttcagcaaaaagcaactatgctcaatttatatctaatacatcagcaagcaatgctgataaaatggtttctaataaagaaatgcccaaggaacctgaagacacatatgcaaaaggtgaagactttacagtgactagtaagccagccggactttcagaagatcagaagactgcctttagtatcatttctgaaggctgtgagatattgaatattcatgctccggcctttatttcttcaatcgatcaggaagaaagtgaacaaatgcaagataaattagaatatttggaagagaaagcctcatttaaaaccataccactccctgatgatagtgaaacagttgcttgtcataaaacattaaagagcaggttagaagatgaaaaagttaccccattgaaagaaaataaacaaaaggaaactcataagacaaaagaagagatatccacagattcagaaactgatttatcatttattcagcccacaattcccagtgaagaggattattttgaaaaatatactttgattgattataacatctccccagacccagaaaaacagaaagctccacagaaattaaatgttgaagagaaactctcaaaggaagttacagaagaaactatctctttcccagtaagttcagtggaaagtgcactagaacatgaatatgacttggtgaaattagatgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggtaaatagatgttgaacacacataattaataatatatatatacacatttaatttgcttttacattttctcaattttaaagatgattaatatttgatcattgatctttaagcagaatggtctgaaagcaaactaagaatatttctccaagaatttagttaaggtaggcttgacagacattcattgagtacagcccaccctccttatccttgagttctgcatgcttagaatcaaccaaccgcagatc

SEQ ID NO: 465006 - DNA, 2906 bp, Homo sapiens
tctctcctcaaatatggctggttggagaaaaaggaatgtaacggaacatatcaaaggagatgtctctcctggccgcttgacaactctggtgggatcttcccatgaccagcgctgctgtatgactcacggctccacttctttccctgcccttttgtggcaggaagggaagatgctgtgcttctcactcatgaattgtgcttcttatgactcagtcggccagcctgttagcattgatttgttcttggtggacaccgttgggcagaaggccctgctaaccacagaagcgagggtgaagtgtgcgctcaccaccatcagcaaggtgaatgatggtgccttgattatgggccaagaggcagatgcatgcatgcttttccacacagcacccttttattgaatgcaaaatagaactttaaagaaaaaaaatggtgaagtttaacgttagtcggttttactaataactgtattacaaaagcttggtactacatgaagtgtaataattggagctattcaagtaacggaaggtgttgccccgagaacagtgaggtcccatcactggacgtgttccacggagactgctgaaggtttgtttattaattgtttttggtaagttttgttgctgctggttgtggggggtacgtactgctttttttgagctgtagtatttttgggaaaggtcttgtagtttcactcttgaagttagtaaaaccactgaacctactgggaagaaggaacaacttcagactcttatacttaagagctgtaactttcatctggaaggtctgtagctctactcgtgagcaagcgggaccactgaacccccccaaccaccaattaacgaatgaaactcctgatatatccgaacctcaaaaggaacgaactttggatataccacctttaagaactgtaatgctcaccgtgagggtccgtggcttcattcttgaagttagtgagaccaagaacccacccatgctggacacaaagggagcatgtatatatatatatatatatatatatatatatatatatatccacgttgggaaagaaatctatgttatggaggaagttagaccaaatagtgtctaggaccccttctatattttcctgaagttgctgtgacgtagcggaaacccagggcttaaacaacaaaatttatttttctctttttctggaggctcgagggctgaaatcaatgtttgggcagggacaagctccttctgatgccccagggaaggctctgctccagcctctttccagcttctagttctctggcttgtggcggtgttgttccagcttttacgtggcattctccctgtatgtatgtctgcatctagatttctccttaaaaggtcacaagtcctgtaggattagttttcctctggcgtgagttcatcttgactaattacatgtccaacaactgtatcttcgaattaagtttcagataaggccacatcctgaggtaagaggggctaggacttgaacatacgaatttgcaggggacacaatttaacccataacactttccaactctgcaatttgattgaccagaataaagacatatacaagtataactaaaataaggcacccatttacgctattcgtagccgtttttagttaactgcgcatctaaacttggcattcacgtgtctggtcttaaagagaacgtgtgtttttttcttatcctgaattcctttcagaagacctttcactgtccatattccattagctccatggaggacttacttcctgcaggctctgcttgcctcccacaagagattctttgccttgattgcacttaatagaagtataatctggccttcaaatcacccgttcatttgattttcccagtaatccctttgctctctgtgtctgcatttgccagctgggtctagagctgactttttcccatctgaagggaggatgcttcccccgttaacattcgcttttcttcctttgaaccgtgagggtgtgtggatgatccctcaggacttaaaccccgacaaacctcagcaacaccagaacatcgctttccaatccctccttaatcagaacgtaatgaaactttgaaacaaaagcttttcaaattagatgaatgattccatcacaggagatcaaaggcaggacagctaattaggacaaaatcttgtccacagagtttctctggtaataatggaaatattcttcttatcatattacaagaaaaataggaaaattcatatatccggtataatttcaactgtggggacaaaacagaaaaagggctgtagtgactccagggaacgtgtgaacagtggttatcagcggatcacagaatgcaggaaaatatccatttctatctttaaactgatctgaaaatttaggaccagagtggaagtcaacactggccctgcgtgtagtttcagaaaaggcgcctcctggacctgccgcactttgataccctcctttgcacaccccatttcatttgtcctgctatcaacttgacatcagcatttccacacccaaatatcccttatatgctcttctgacagtgaggatgtttgctccctactgaaacagagtttagaactcacaccttgttaacaggttgtcaaaattcgttttgctagtctattgtttttcttctaatacaaaaagatttgctgatttgttctttcggattattataccacatttcctctgtgtctaagccgtgcttgaaagaacagacatttttcagagcctgttgctggtaactttcttcacagaacactgatgctttgttggtggctgggaagccagtggaagctttttcagggtggctgccttgatcttctcattgaaaacagtatactgctgactgtgattcctactgttatgggagagagatgaagttttttctttttctctttcttttatattcttttaaaaaa

SEQ ID NO: 465007 - DNA, 2427 bp, Homo sapiens
cgctgtgatcaatgattcctgtctggccagagctggtttaaatgttccctctatggggctcagaagaagacaagaaaatgtgggaaagtgtggtacttcctagagatttgttgaatggctttgaccaaggtgctgatagtgatgtggacaataaagcccaggctgaggtgatctcagacagaaatgaggaacttgtggggaactggagcaaagctgcagaaatctgcataactaatgaggagcccaatgttaatcaccaagacaatggggaaaatgtccccagggcatgtcagaagtcttcatggcagcccctcccatcacaggcctggagacctaggaggaaaaagtggttttgtgggctggacacagggtccctgtgctgtgtgcagcctagggacttggtgccttgcaccgcagccactccagccctggctaaaaggggccaatgtagagctcgggccacggtttcagagggtgcaagcctcaagcctttgcagcttacatgtggtgttgagcctatgagtgcacagaaggcagtgcagaagggaaatgtgggatgggagcccccacacagagtgcctactggggcactgcctggtggagatataagaagaaggccaccatcttccagaccccagaatggtagatccacttacagcttgcactgtgtgactggaaaagatgtggacactcaacaccagcccatgaaggcagccatgagggaggctgtactctgcaaaaccacagaggtagagctgctcaagaccatgggaatccacctcttgcataagcgcgaccagggtaaagatgaaaacgtgtaatttcctcttatgctcataaattttcaacattacttcttaaaaaaaatcatgtttttctgctagacttgtacaattctagctaagagcctgctgtgtagagcatgtcaaaatcttttgagctaataactgcatctgacttgataaacagagctgtactattttttttccgtgaatattatgcatttgcccaattttacattttttaatgaaatgtccaaggcctattatttcagaaaaacatacattcactttattttaccaaaatatttttttaaatccatcctcaaattctttgtgttagtctaaaaatagtttacttacatagctaaatacacaaagataatagcatataggaagaacattgttctttcaagtactgtgtttctcatctgattagttagcaatttgtacaattacacttaaatggatgcaatgctgatatcactgcttattttactgcagtagtaaaacaggtacagtgctatctgccctgcttgtttataatattaccataaacaattttgtgtgcactctatttcaatttctcagcttgattagctaacaatcttcactaaaacattcaaggtaaaatggaaagctaattgcatagagatttttaagctcatttgcacacaacagcatttgttagtaccaatgaaggtaaaaaacagtatgacttctctcctagcttcactaattccctctgctaattcaaaatgtccacatagaaaccaaatgaggtagaacataaaaatagtatttttggtaagggcagtatttgaaaagaagaaaatgtttcttgggtctatgtacaggtgatgaatcacttttattctattatattgtgcaaattttagaatgttccatctaatgatgtaaagaaagctaaagattctttatagaaatggttttcattcattgcattctcctgcaattttctgttaggtatctctttttcactcctagcaactgaatgatatcaattatgggattataaagaaggaatctaggtgataaaaggctcaaaatatataacacagagaactggtataaaaatttttcttcctagaatggtaaatagaaaagtttaataaagagtgtaaagccaggtcaaaatgggattctcttaatttttaaaagcatcaaaaatgattataaaatataatattttagcacagttaaagtactgttgaattataaactttgaaagatagcagtcataaatatatatggacttagaggtcaataaattcaaagtactttttttaaaaataataattttctggtaaaaagtccataaaaggaggtgttatggtttggatctatgttcccaccaaatctcatgtaaaattataatctctagtgctgcaggtagggcccggtgggagatgattggatcatagaggtagagttctcatgaatgggttagcactatcctctaggctctgttgtcatgagaatgggaacataaatgatttatcataagatctggttgtttcaaaagtgtgtagcacctcccccatctctcttgctcgctcctgttctggccatgtaagacattcctgctttcccttcaccttccaccatgattctgtttcctgaggtc

SEQ ID NO: 465008 - DNA, 1206 bp, Homo sapiens
gatgagaggattggaacttttaactacacccaacaacctccaggaaagggagtggggctggatggatgtcaagctctataaaaactcggacaacatgatttgatgaacttccgggttgctgaagatacagagatgttgggaggctagcacacccagagacagcatggccgctctgtgcctgctttcctccccttacctcatcctatctatcttcatctgtctgttcatgtttatcctttataatatccttcataataaaccagcaaatataagttgtttacctgagttcggtgagccaacctagcaaattaattaaatgctggaagaaggttgtgggaaccctgatttgtagcaggtcagagtataggtgacaacctaatacttaaatctgaagtgaaggcaatcttgtggggctgaaccctcaaactgtgggatctgacattatctccaggtaaattgccaggtggattacactagtccaggtagatagtgtcagaattgaattcaattatataatacccatttggtgtccagtggagaattgcttagttttgggaatagccccccacacatctgttcacagaagtgttctgtgtttagtgtgagagtgggattgtgggaaacagaatgtgtttttttttctttttttacaggcaacacaaatggactaagacatataccattagcacttttggaacatgatttactttactggcacggtacatatataaaataaactcttttatccttttgaaaatcaataaatatgcattgaatgcctatgtgtttatgtagtaaccgggacctacccttaggtgaggcacagatggacacgcagagtcaacacactagtggtcccaagctggaaatcgagtttaggaactggtataaggaacaagcaccagaagccagtttgactgttaaaactgataaaactgataaaactcctaatatatccttcaatatgcaaggagtgatacacagaaacctggcaacaaatgcaaacatagacaaatgggattacatcaaactaaaaatcttcatagcaaaggaaataatcaacagagtgaagaggcaatgtatagaatgggagaaaatatttgcaaactatacacctaagaggttaatactcaaaatatataaggaatgtaaacaatttaatagcaagaagaccacccaactggaaaatgggccaaagatgtgaat

SEQ ID NO: 465009 - DNA, 6416 bp, Homo sapiens
ggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggttttttttattttgttttgttttgtttttttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggaaaaaaaaaaataaatataataaaagggg

SEQ ID NO: 465010 - DNA, 860 bp, Homo sapiens
ccacgcgtccgcccacgcggtccggtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattcaaaaaaaaa

SEQ ID NO: 465011 - DNA, 5653 bp, Homo sapiens
ggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggttttttttattttgttttgttttgtttttttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtataca

SEQ ID NO: 465012 - DNA, 6459 bp, Homo sapiens
ggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggttttttttattttgttttgttttgtttttttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattcaaaaaaaaa

SEQ ID NO: 465013 - DNA, 1135 bp, Homo sapiens
atgatcatagacaaccagtgcaggctctctggccctcagtttcttcatctgtggttaaatgagcctcctgaaatcatgcatagcccttaaggtgtgtgtgcatttctctggggagaggatttgtagcgtgcatcacatttttcaaaggagcttaaaatctggaaagcccacgatctactgttctgctccaaattccctgtttttcagtgaggaaaagggggagaagattaaagcctccacgggctggtcctgctttgattctccagtggactcagacgagatcagagaaagttgttggcagctcccgagtattctcacactaaatgagcagtatagagtaagtacagccttgttgattgtacatcaatttgatggactaactatggtacaggttgaagcaggtagaggagtctgccaagtagctgagacagacactgccctgggatgcagattagtaaccatgaggctcacttctcctcgattacaagtgggcttgtaatccaacttattccaaacactccacccacaaggcagcaagtgagggaaaaaatagaattctgcttgaagataataaaatagcaggagctatgtcaatcaatagcctagaacccagctacctgccctcctgcatgatgccctccttcttcctctcccttcactaagttaccatctggaatagaatccaatagtgatccaccaatggacaatttttgctatgaaggaggaaagagaggacagatttgattacaacaaaagcatcccaagaatgtgtcctgcatgagctcttcaggctgtgaaatcttgaacttctacacccatccttggctggctttttccatgtgaggccatatagagtaacttatgaggtattaccaccgtcattttccagaagaagaaagctgaggctcagagtgatcaagaatacccagccagaacgtggcatctgggacttctgtctccactctgttatccaccagcacccttgggccctattgcttggctagatgggcactctgcatgtatcaggcattgtctgtcacctgagtcactacatgtatgacatcatatgtctattaccagtctcagatatacactaagaaaataagatttcattaaagtattttctaaattcatg

SEQ ID NO: 465014 - DNA, 1358 bp, Homo sapiens
atgatcatagacaaccagtgcaggctctctggccctcagtttcttcatctgtggttaaatgagcctcctgaaatcatgcatagcccttaaggtgtgtgtgcatttctctggggagaggatttgtagcgtgcatcacatttttcaaaggagcttaaaatctggaaagcccacgatctactgttctgctccaaattccctgtttttcagtgaggaaaagggggagaagattaaagcctccacgggctggtcctgctttgattctccagtggactcagacgagatcagagaaagttgttggcagctcccgagtattctcacactaaatgagcagtatagagtaagtacagccttgttgattgtacatcaatttgatggactaactatggtacaggttgaagcaggtagaggagtctgccaagtagctgagacagacactgccctgggatgcagattagtaaccatgaggctcacttctcctcgattacaagtgggcttgtaatccaacttattccaaacactccacccacaaggcagcaagtgagggaaaaaatagaattctgcttgaagataataaaatagcaggagctatgtcaatcaatagcctagaacccagctacctgccctcctgcatgatgccctccttcttcctctcccttcactaagttaccatctggaatagaatccaatagtgatccaccaatggacaatttttgctatgaaggaggaaagagaggacagatttgattacaacaaaagcatcccaagaatgtgtcctgcatgagctcttcaggctgtgaaatcttgaacttctacacccatccttggctggctttttccatgtgaggccatatagagttgctgcaggtgataagcatcctgatggaactgagcttcactaacaggaggacaacactgattgcagtatcagggatgatatagtttgagccggattatagagctcatcaactgatccacatcttaaatgctccatctttggcataaggtgtttgtaaataatatgcagggcatttataaatatgatgggatacttaataccaaaattaactataagtgaattgctgggatagaataaaatacagaaaacgaatacataagatcaatatgttaccataaaattaaaatatttaatagcttcaatttctacttatgtcaaaattcctgtaattatgtttaatatcctttccccttttctgcccacattctgggaactgtcctattaataatgaaatgagagctagataaaaagataaggaagggaatcaaaagggttgcttattcttttcttgattaatcaaggaatcattagttatatttgaagaatataatactatctcttt

SEQ ID NO: 465015 - DNA, 975 bp, Homo sapiens
  misc_feature (3)..(3): n is a, c, g, or t
  misc_feature (14)..(15): n is a, c, g, or t
agnaagacccaccnncgaagccccatcctcaatgtgggtgggcaccatccgatcggctgccagcacaactagaaaaagcaggcagaagaaggtggaagaagatgacttgctgagtcttctggccttcatctttctcttctgctggatgcttcctgccctcaaacatcagactccacgttcttcagcttttggactcttggacttacaccagtggtatgctaggggctctccggccttcagccacagactgaaggctgcactggttaagctcaaatgtgatttctgctcttcccctgcaaattgttcaataaaggactggaagtactgtgaaaaaagaaagagagaaagaaatgttcttatcatccacaatatacttctccttccaacagcaaatctaaccacagctgggaaaaagcagcaaaaacaaacaaacaaaaagacttaattggaaaatcactttgcctccttgtccacccccaggtgctaaagcaagggataaaccaaaaggacagccagtaggtgaggagaggccatggaatacccgccaacaagataatcatcgctggaataatagggacctgtctgaataacccaagaagaggggaaaccagcatgtcaccagctgctgtgatggagtcaggtagcacagggaagtggctcagagcagggactctggagctagactgcctgcgtttgagatcctgctcagccaattactagctgggtgatcttggcaaggttttttgttaaaactgttatgccttaatatctttaaaatagggataataatactatgcatctcattgagttgcctaaaattctgtaattcagcccttctttacaatggagagcattggcatagatttcaacaaaaggcagataatgagaatctgctatttggttttctactatatttctctatttgcatttgcatctggatttgactgttaataaacctgtgaagtcacattttat

SEQ ID NO: 465016 - DNA, 865 bp, Homo sapiens
  misc_feature (3)..(3): n is a, c, g, or t
  misc_feature (14)..(15): n is a, c, g, or t
agnaagacccaccnncgaagccccatcctcaatgtgggtgggcaccatccgatcggctgccagcacaactagaaaaagcaggcagaagaaggtggaagaagatgacttgctgagtcttctggccttcatctttctcttctgctggatgcttcctgccctcaaacatcagactccacgttcttcagcttttggactcttggacttacaccagtggtatgctaggggctctccggccttcagccacagactgaaggctgcactggttaagctcaaatgtgatttctgctcttcccctgcaaattgttcaataaaggactggaagtactgtgaaaaaagaaagagagaaagaaatgttcttatcatccacaatatacttctccttccaacagcaaatctaaccacagctgggaaaaagcagcaaaaacaaacaaacaaaaagacttaattggaaaatcactttgcctccttgtccacccccaggtgctaaagcaagggataaaccaaaaggacagccagtaggtgaggagaggccatggaatacccgccaacaagataatcatcgctggaataatagggacctgtctgaatgtaggtatgtgtgccgaagacttctacgtgctctcgcagtccattatctggcattccctactttcatccgtgttatatacctgccatctcatcactcacagccactcggaatcccctggtggccctccagcaggaggtctttctcctctcttgagcttctaaaacactgtacaaaatcactttaaactgcttcctgcctcagtattgcccacatagaaaccttccccgtcaatgaaatggattcttttttaaaaattttttttattgattttctttt

SEQ ID NO: 465017 - DNA, 2094 bp, Homo sapiens
cgccggtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagaggaaaccggcgtgcgccggtaaaggttcctccagagcgacccccacccagcccgtactcacgtttgttcccgggcttctgggggcgcccagcccgtgtcaacatcatgttctgtcgcccctcttttgggcctcctaagggccatcgaaaggaaacgacttcaggctttaactgagtagagggcagacgctcctgccggccttacaggtgctggatggccatggacccaactttagcagaaaatccttttcagatggaagttggatgggaagggttttctagtggttttggagtatctattctattcacatctggtattattattccctataaactgacatattttaagagggttgcatgaacagtttttctttgatacattatagtcttaatgtgataaatttaagcaaaccgttggagacaaaggatagcattgtcttaccatgatgtgagacccgagccttttgagtatatatactattttataaacagatgctttgcagtttgggtcattttccattagaaaaaataaaaagcctgtggggtgtgagtattcattatccccattttacagataaggcagctgacgacaggatttttattttgtccagaggaaatgatgaagttagaattagaactcagatctctcagactccaaagcttgttttgtggtcttaattgttatgtaagcatctttaaagttatgccaccctgcggagtatgtaaatgttgaataataaattctttgttttctttttatgtttgttttagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtatgtaagaggtagattcccacaaaaaacttttcttcacttagcttttgtgtttaaatttataatatgactactaaatataaacataatatagtattcttttgtgaaataacaaattgtgcttatccatttgtttttttcacaaagtagaatgtagtttcctttttcaaatagctactgattagttcatttctatgactcaagttatttgcagttcctgggacatcttttcatgtatgttagttgcactttcttactttagctttaagaatcttgacttcttttgttgtttttttctaacagtagatatgtatatatttttccctctctaggtgaatcaattcagatatttgctgagattgagaactgctcttcccgaatggtggtgccaaaggcagccatttaccaacacaggccttctatgccaagggaaaatgaaggaagtaatacagcttgtggctaacttgcgtggggtaggaggt

SEQ ID NO: 465018 - DNA, 471 bp, Homo sapiens
cgccggtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggaagtggtattacgaggctataccaccagatgaaacaagataggatcaccagataccagggtgttaatctttatgtgaccaatcttgatgatatattgatgatgacgtctccggaaagagttttctccctttggtacatcatacgcgagtatgatgagga

SEQ ID NO: 465019 - DNA, 1325 bp, Homo sapiens
cgccggtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtatgtaagaggtagattcccacaaaaaacttttcttcacttagcttttgtgtttaaatttataatatgactactaaatataaacataatatagtattcttttgtgaaataacaaattgtgcttatccatttgtttttttcacaaagtagaatgtagtttcctttttcaaatagctactgattagttcatttctatgactcaagttatttgcagttcctgggacatcttttcatgtatgttagttgcactttcttactttagctttaagaatcttgacttcttttgttgtttttttctaacagtagatatgtatatatttttccctctctaggtgaatcaattcagatatttgctgagattgagaactgctcttcccgaatggtggtgccaaaggcagccatttaccaacacaggccttctatgccaagggaaaatgaaggaagtaatacagcttgtggctaacttgcgtggggtaggaggt

SEQ ID NO: 465020 - DNA, 993 bp, Homo sapiens
cgccggtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaacacaggccttctatgccaagggaaaatgaaggaagtaatacagcttgtggctaacttgcgtggggtaggaggt

SEQ ID NO: 465021 - DNA, 1184 bp, Homo sapiens
cacgcgcctgttgacccagggaaagcgctgagaaagcatctcactcctgatctaactttacttattttttccgagataattccaactaaattatttcagctacatacgcctttccattgtttcggacacgatgattaaatcagagagcgatggtgaatagaccacagagcacttagatcaactgcgtgacgaaaaaggagacctgtgtgttgcttctcaaactttgctgccctgtggaatcacctggagagttcaaaacatatatattgattcttgggtcccacctctagagactctgatttaattggaacaggacaggatctggtctgggcattgagaaatcaccagagattgcgccactgcagtccgcagtccgacctgggcgacagagcgagactccgtctcaaaaaaaaaaaaaaaaaaaaaaaaagaaatcaccagatttaccatcttgtcttaattatttttttaacttatcctgcacactttcagaaggtctagtaaaatttcatgttctttataatgaaaataacaattgtccacattttgagaaatgactgctgcatgacaaacatcctgagccgatctatgagggaatgacagaaagttggcaggaaaatgccagctccgttggggagaccctaacccaaataagaagatttaccattactagacccatctgtaaaacaatgaaaacaggctgcatgttgtttactgcaggaattgtaaatgcaaactgttcacagtcttgctcagctaaagggatagtaaagaaacaatcttttaaatctatgactattaaagcccaattttttggaattatagcaggagaaggcaatcctggctgtaatgctcccataggttatataactgaattgatagctctgaagtcagttaacattctccatttacctgattttttcttaattacgaaaactggagaattccaaggagaaaatgctggagctatgtgcccattttctaattgttcagtaactaatttctccaaagcctccagtttctctttacttagcggccattgttctatccaaattggcttatctgttaaccattctaaaggtataggttctggaggcttaacaatggctgccatcaaaaatgatatcctaatctttggcgggaactttttaaaccttgcaaatttttttttctagtcctgttcc

SEQ ID NO: 465022 - DNA, 1367 bp, Homo sapiens
tttaatgatataatgactgttgccaagcatccactttgagggaaatatgggtttaatcattcacaggagcaatccaccacaggcaaacacttgagtcactaaacattttcacgtgtgcgaataatgcctgatttcagggtctctgtttagtctgtttcaggatattgaggattctcgggatttttttgccataagccttaggcactcgtgatgacaactcccgctattataatttaagagtggacagatgaattgattctgggtccttgtggcacacttgttaaaacttcctggcaggacagggtccccctgtgtacacagttgaaaacttgcagtccaagtgactcacaggctcttcagttaccatggtgatattccattacaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagaggtatatatagccaaccacatggaagcattctgtgttatttgttattgttgttgttgttagtgaaatcacagtttctgtatatcaaagcccccttgtcaatgattttggttacccctctcagaacata

SEQ ID NO: 465023 - DNA, 1049 bp, Homo sapiens
agcttggacatgctctcctcatgcaaacacaaaagcacaagagagcgagtgggaacgcatgctgcccctgaagatgttgaaacttctgctaacgccgccttggttaaagcagctcctatggccaaacccaacaccaagggacagataatcctgctgtggctgccaattcacatggtgaagccacgaatggatcattatgaatgtgacaagaatgaaagccaggttgaaggagacaaagcagtgagagtcaacaagatggaaataggaaaagctttgaacacttttgtcagcagtggagaaaccagcagagaagaagtgacagaagacattgaaaaaacatcaggaaaatggatgagcaaaattccagagaaactgagaagcagggatctgtaattgtcttctcaaagacagcaacaaatcaaagaagggagaccaagatttatagaggctttaggaaattagaagtaaagcagagagctcaggcacttgctaaaacgaatagaaaaaaatgaggaccaccatcaattccaacattgagaactcgtattttagttggaaagaaatgcacacagtttggaatcctatgtaatcaagataagagaacaacaattttccaaatgctttccgtgggccagcgtggaaacttaactctctcacacagacaacgagattacactctgacaccaagccctgcccttgtgggaagtatgataagcctcaaggcaaacaattcttccttcgcgattgcagtctgggcacctgatgatatagaatgactcattggactcctgcctcttctacttcattcttaccatgagctcccctagaagatgtagtcttccaccgttaccaaaatctgcaaccagaaagatcaagctctaggaagcagtacacactatactcctgtgtggaaacaaagtaatcctcatcagatcatctaacttgctgttgctgtaaggactgtgaattggtagcaataaataagccatgggaaataggagggaaaacaccatcaatgacaataaaaactgaatgtgaaatttgactac

SEQ ID NO: 465024 - DNA, 2365 bp, Homo sapiens
cataaggcatacaaggcatacagacatgaggcaagaaaagatgtttgctgagaacacatgctttggaatagaacagaatccattggtccaatatggatggagaaactctttctttttcttcctctttggtggttcatccttggagctgctatctgtgctggtgctgctgctactggaagagctggaatctgagtctgaatcagaggaggaggaagaggttgtggaggaggctgaggatgaggaattagaagagctttcatcaatgtcactgtcctctgaggaggatgaggcaaatgctgtggaaccccatataagcagtaaaatgattaagctagaagtgtttaacaaattgccaaaggctaagtgtggaatagtgaaccaatgtgaagactctagtttctgcagacatatgggagttgtatgtctgcagaagccaggatcttcacactggtacactattcaacacttgttacattattacactgtgaagttttttgcaggttttcccagtatgattaccaccgggtgctcccagattagataaggagacattcattagccagaaagaaaacagttttgtttcaacttgtatatcttcaaagagataatatgcttcagaaatgaaatgaatgaagatgaaatataatattttaattttacttttaatttctctaaaataaacttttcacaaaaagttgtagaaatatagtatgttcataacatgaaaacttgaaagttttgactgtaatgacacatagaaggggatggatttattgggaatattatggtgcaagtctactattctataaataaaaccatatagtattatttaagggtggattcagattatttcaaaatataagttgaaaacccaagacgatcatttaaagaaatttttttaaaagatggatatattgtcctagttaaagagggtaatgacatgacggtcaggtttcaagaagccataataatcttaattatgtatataatatacactaatacatcaaactatatgagttactttgaaatacataattgttaactagtcacattgttatgcaatggaacactagaatttattcctcctatattactggaactttgtatgttttgaccaacctttccccatccaccctaccctcaacccttcaaagcttccagtaaaacaactatgctgctctccacttcgatgagatcaactttttaaaattttacatgcgaagctacatctgattccagtggggctttgttaatgcgatcctttctcactgtacctgttgcctgatgttccattgaactgagcttatcaagaagtgcaatactggtgaaaaagttatcgaatacaaaatgatattgtccagggtgtgtgtaagtccctcactaaacttatgaataagtgatgcaccaacaccgtattcttcatatttagtatttgggtttttaccctgatacggctgaaagcagcaaatgtggcacagacatgtggcaccacaacaaaacttacagccaaacataatgggctttccctgaataaattgtttgcacctgtgacaaccagaataaggaaccatggattcattaaagctgaaatatgtctcatttggaacaaatttcatacatctctcattacgtttgcttatgagaagtcgcaacttggaaaatttgtccattggatccaaatttgcatcgtcagcaacatgcaaattagaaaatttagtttcaaagcggtcacgtctcatggcagcaataaccagtacattatgcgcatctggtttgttgttgttgttgttcccaaaacatacggcttctaggaactgagatgtaaccactcagaaaaataattcccagaaaatatttgaattcggagctagtcaagccaagatgtacacccttaacttcgagcctggacaaagtgtagtgccgaattatccaataaatatttactgaatgattgtgtgaaagtagtcagtgaacaaatgtgtgtgtttgtgtgtgtgtgtggtctgcgttgcctaaattttgtataaactattttataatctttaattttaaaatttaaatatggacatgctccctaggaaaatacatagaaaagttcaggttatttatatctctgtatctaattctattgatatacatttccaaatttattaatatagtaaactaaattaaaactattatgaagccacattaatatcttattttacagaaacaataaattcatgtccattgattttcatgtcattttaatgttttctaactgttattattttcaagtcaaataaggtttatttgcctttaccaaggctttatttgttttcaacgctaaaattaatcacattaaaccttaacaaatcttcttcct

SEQ ID NO: 465025 - DNA, 1532 bp, Homo sapiens
cgggacaagacaactttctcctcaccatggtggctgagttctggaggctgtaatttcgtggatttctgtggagctggcagagctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaaccccaatgccattggtcgtgcttggctgaacccagaagacctggctgctgctctctggaggttgacagagtgggccactggcccagtgctttttacagaaatgggctctcctaagcaggactactggcatcattcctcattttgtaagaggtgggtcaacgtaatgagaactccaagtgatgatgtggggagagtggaagatggggacctggtaaacagacctatggctgcccccagttttgctggacctcttgctgtaccccataaaggaaaccagggaagtcagaagtacaggaccgctaggccagggctgcccaacacaactccccgcagtgagggcaaggcccacccctgccctgtccccacagagccacttgccacgtgtgacactgtgatccaggatattcgcagggaaatcactcttaggaacacttgctgtgtctctatgatttctttgttttcccattgtagccatggaaataaagaaaccttctcttgccggggaatcaagctggctgttgactggttcagggacagaggacacacctacatcaaagtttttgttccatcctggaggaaggacccaccaagagctgacacccctatcagaggtatgctggagcagatgtatgctcaagaggaggtcaacagccacaatgggaggcttcttccttcctagttgtagcttcactttctttatagggatagggatgggaaatgagtggaggtccattctcctgggagcagctgccagggagtagctcagctcacctgttagtcatcccgattttgcccgacttccactccatctccaccaccagaagtgctccaagactgcagggcaatggctcccacctccactccagccttctgcgcatattctgggctgtggttccctccatgctgcacaatcaatacaatcctctctgctttctgtcttcccaaagtatgtcaaaatcctgggtttgctgctgtccccaaacctacttttaacatgattatagatctccccccacctttcattacattggaactatgagaaagagggaatataaatacttgtgttcagttccctgtcatgaactgg

SEQ ID NO: 465026 - DNA, 1706 bp, Homo sapiens
tttttttcttaaaaaaaaaaaaaccaaaaaaacccaaagcataactacttttgcagctgaacgtgactgtggcgtgcaggaagtggagcattggcatgaagtggctcctagtggctgcttggcgcacgccagctgccctcctctgactccagtggcacctgggggcctggcctcactgacgggagaacattggcgtgaaggctgctggcgactgggccagcattcattgtgaagaccggagggacacaccctgctgctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaaccccaatgccattggtcgtgcttggctgaacccagaagacctggctgctgctctctggaggttgacagagtgggccactggcccagtgctttttacagaaatgggctctcctaagcaggactactggcatcattcctcattttgtaagaggtgggtcaacgtaatgagaactccaagtgatgatgtggggagagtggaagatggggacctggtaaacagacctatggctgcccccagttttgctggacctcttgctgtaccccataaaggaaaccagggaagtcagaagtacaggaccgctaggccagggctgcccaacacaactccccgcagtgagggcaaggcccacccctgccctgtccccacagagccacttgccacgtgtgacactgtgatccaggatattcgcagggaaatcactcttaggaacacttgctgtgtctctatgatttctttgttttcccattgtagccatggaaataaagaaaccttctcttgccggggaatcaagctggctgttgactggttcagggacagaggacacacctacatcaaagtttttgttccatcctggaggaaggacccaccaagagctgacacccctatcagaggtatgctggagcagatgtatgctcaagaggaggtcaacagccacaatgggaggcttcttccttcctagttgtagcttcactttctttatagggatagggatgggaaatgagtggaggtccattctcctgggagcagctgccagggagtagctcagctcacctgttagtcatcccgattttgcccgacttccactccatctccaccaccagaagtgctccaagactgcagggcaatggctcccacctccactccagccttctgcgcatattctgggctgtggttccctccatgctgcacaatcaatacaatcctctctgctttctgtcttcccaaagtatgtcaaaatcctgggtttgctgctgtccccaaacctacttttaacatgattatagatctccccccacctttcattacattggaactatgagaaagagggaatataaatacttgtgttcagttccctgtcatgaactgg

SEQ ID NO: 465027 - DNA, 670 bp, Homo sapiens
tgcgggtctcttcctgcactatccagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcaggtgagggttccagccgctggcccacagctgaaagttggcacactgttcacgtgctccttctaaggtttgccaggtaaaggaacaggttggcggtgacgcgtacttgtgtgtgtacctgctttacgctgacattttagcatgcagctttaagtttacactcttgg

SEQ ID NO: 465028 - DNA, 3589 bp, Homo sapiens
ccgagcaggagcttcatggtcccacacaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtctgtggtacaatatgaacaatatgagcaagaaatgaaacatctccagcaactgatagaaggagctcacagagagattgaggataaacctgttgccaccagtaacatacaggagctgcaggctcagatttctcggcatgagaaaccactcattcggcctcatcccctcatttctccttttgtaccgacgcggggacgcgggctcgggcactttggctgtgcctgcgccgcgccgcgcagcctgcggtctggctcggtagcgagatgcaggaggactcgccgcctacacatcctgcctcccgggcccgcgcggctctgcgcgctcattggctcgccctgcaggaagatgaacgctactacttctgagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatggtgtttttggatggaagagagaaagtcaacaaagccagagaggatgttaatagaccaagatccttgaaaaagcagtttatgggattctcagagtctgtgggagagtcaggtttaagcagtgaaactggaaagcataagataaggctgtcccagtctgaattcattctaccgcatgacactgctacatttgtttctcagacggctggagccttcttcaatactttttaccaatacatgattctcaataagactcaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcagttggtagtagtcgtactagccatcacagcagtaaggaggtacagctaatttagtgaagattaccagtcattggggcttaatggtttattaagagagaaaatatattaatatatcatattaatataattgcatatattaatatatcatattaatataattgcatatattaatatatcatattaatataattgcatatattaatatatcatattaatataattgcatatattaatatatcatattaatataattgcatatattaatatatcatattaatataattgcatatattaatatatcatattaatataattgtatatattaatatatcatattaatataattagaacatattaatgttctaatgagagggaaagaaaatagcaataatgtagaatttagtatataatttcatgtatcatcacatatttcatctgagctatttttgctaccttttgctgtctgtgccagaagttctacaagttctggaacacagctgcccacatgaaaagctggtggtatcacagtatctaaatttgttcttagcttcaggaatggtactttaaaaatgtcaagcactgttatagaattactatttctaaatttcaactgaatgggtagaaatttaaagccgatgtgtctgccctacttcttaatttctattttaaatggtttaataaaattaattttaaaataatgaattattcataaaataatttttaaaataaagtatttagagtattttaaaagttaacttttaattcatttatattgtccccagtaactctatgaaaaacttgtgggggtttcaaaatgaagcgattgacgtcgatttttttttcaacatgaattatttgcaatcattgaaaaactcagagagctaacctagaaatttggatttctccctttactggagatgaaagttaacactgggccaccgcttcccacagggatcaattgcctgaaactgtatgtggctgctgttttagacaggccgcatgtttttcagtttgccacagtctccatcactccctactcttcccagaaatagaggtccggtgtctactgccatttaccaaccgctttatgccattgttttgttctaatccttgactgatttccatcatttctattactgcctggtcctataggtatgttatttgagaataccttgttcaactctaggtacacattaaaatcactagggagtctttttaaaaataccaattttgagactcacccctagaaattctgattgttgttctgggatgtggcctaagcaaaggaaatttttaaaagttttaccagtgattcttatgtacagccagggcctggaaccattgctttactgtgttaaattctcaagattttaccttagcgtgatctatattaccttctactgaattcaacaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcaggtgagggttccagccgctggcccacagctgaaagttggcacactgttcacgtgctccttctaaggtttgccaggtaaaggaacaggttggcggtgacgcgtacttgtgtgtgtacctgctttacgctgacattttagcatgcagctttaagtttacactcttgg

SEQ ID NO: 465029 - DNA, 297 bp, Homo sapiens
catatacaatatctgaagtttttcctctgaagaacagttccgtataacgacaccaagatttaattcgacccctataaaagcagcatctcactttattgatcatacttcaaagcatatactcaatagttaaggatcaataatttctgtttggtttgggtctttccactcgtgactttctatgattttttactcccctccccctatatcctgttccataagtacacgggtgctctagattttcctatcaatacgccatttacaactatctcgggggaaggttaatggttgatattgcta

SEQ ID NO: 465030 - DNA, 2363 bp, Homo sapiens
gcaagctcggggcggtgttggaaatctgaatgtcacccgcggtccggagcagataggatgggctgggaaggtacccgcgaactgccgccggaattcgctggcagctgtgcgaggattatttaaattttccacaaatttctacggattaattcaatggcagctcactttctccttttatgatcggatgggtccgaaagtgaggaaaaagacaattgtctacaaagaaagaggctgccaagtggagacagaaaagcagttatgagactgatgatagattccaatttgttatcgaaaggaaggaggagacctgaacagtacatccggagaatccagcaaagcatactacggcatgaacgtgcaagtggacagaattaaaacacatgccagaaacactaatggattctaaacaagatgcagtttcatttcctgagcctatacgtgatgtttttaactgttctccagttaatatgtctccatttccagaaatctaacaggagaatctctgactgcttaacagatcacctaagcttgcgatttgtgcaatcctttctagagtaagggctccccggctgctccccggccactgtgtacccaaagcagcggctgaaatagcccggagtccaacagctcagcgtcaagcagctcgtggtttgtacttacatcattttttttttcagagcaagagtgaaagtttattaaaaagcgttagaacagtaaggaaaggaaaggagagaaaataaggaaagtacaacttggaagagggccaagcgggcgacttgagaaatcaagtgcctgtacttacatcattcttaaccctttcgctcctggagggggctcagcgggatcagggggcccctgaacttcggaacacgcaggacctgggtgtgagagaagagtcccaaagcttggcgtgagcaatgcactcgcggagggagagagcccggggcttgcggggggctcatcacccgctcgtagacaacgggcccccgcaatccctgcgggctccgccgctgctctcaccgctcaaaacggcaggtgcaaaaagcatttgggagccgcttgccagcgcgcggagcctagtctgggaaactccagccaacccaggatcccattttgtagtcccgggcagacccgaaacccctgaaagaactccactccagaagacgccagaacaagttcccacgaatttcatgggcgcccttcacatgaaaacctcagctcccctatcctcaaggaacggggaagggcgccggggagggacttcggtggccagctgtccctgggtcgtgggcgctgtttgctctgcggagcgccagccctgcacacagcggatctgtaagttgcgaaaaggggcttttgggagcgtcagagctttctcactccggtcccccgccgccttgaggctggcagatttataccccacaggtggatggagacctaaacaaaacagtcccggccgctgcctgccgctcgccccccacgtcccccgggcccaccgcaaacttcaacaaaataaacaactcaccacaggcattcccttgtctgcagcgcgacgcttgccagctgggaaaataagccgcaagccacgcggccgaggcgcggagggaaggcagcgcggcgcccgcccctctcccccaggtggggggcagcgcgactcggggcgggagggaggctccgcctcgggggccgctctcccagttctccgactccagaatgagctctgggagaggagctgcgcccttccagctagcccgatttctccgccatctaggggagagggcggggagccaaatccctcagccccccgcaccccagcagcttcctccaggcagctttctccccagtcagcctcaaatagaggtgaacagagaccctcctctccccccggcaacccctatatcgccacactgccccctgccggcgctatccggctcattccggcactgcggacggctgggggcgggcgccgcagacccccgcgtccaggtcctggatcagttctctcttcgccttccccccaccacactcaatcttgcacaaagacgcctttcacgccgccagcgccaccctccgcgccgccctccgggccggcggcgctgccttcgcccacccgcggcaccagccgattcctggtgggcgattgtgccactcgtcgccaggcagggcggcagcggacgcgtgcgggctgttcccactccgcgccccggccaaggcgccagatgcgctgccccccgccacgttctctagctgcccgccggcagccgcagaatgcacacctttctctccgtaaatgatccttaagggtcttccaagtgtttctaaaatgggtacagtggcgggaatggtccgctggactttcgccg

SEQ ID NO: 465031 - DNA, 2787 bp, Homo sapiens
ataatcccccgccgtgtccctcccttcctccccattggttgtgaccgcacgtcagcccgactcagcctgccaatcgcaggacccagagggccctctcccccgcccgctcagtgtaattcgagttccctgtccatcgactccaagtcctctctcctgcgccgcatgctgcctcgcgctccctttccttccccctctacccccttccgcgatttactgtttcctcgcgcccaacagaaatgggcgaccgcaagtcttactctcgccggcgttacaaaggtaccggcctttgacctctccttgaattaatgtgatccgattcatcttccctccaagttttttttttaatttaattacccctccctgccctcaggtgttctagtttgacatttcccttcctgaaagcggcaaggagaggtctaagagtgggcaaacttcaacgttcggttacagtgtaattaatgagagtggtgggtttttatgcagtgtaattatgccacgatttgttgttgctcagtggctttttcacaaatttctacagattatttaaattttccacaaatttctacggattaattcaatggcagctcactttctccttttatgatcggatgggtccgaaagtgaggaaaaagacaattgtctacaaagaaagaggctgccaagtggagacagaaaagcagttatgagactgatgatagattccaatttgttatcgaaaggaaggaggagacctgaacagtacatccggagaatccagcaaagcatactacggcatgaacgtgcaagtggacagaattaaaacacatgccagaaacactaatggattctaaacaagatgcagtttcatttcctgagcctatacgtgatgtttttaactgttctccagttaatatgtctccatttccagaaatctaacaggagaatctctgactgcttaacagatcacctaagcttgcgatttgtgcaatcctttctagagtaagggctccccggctgctccccggccactgtgtacccaaagcagcggctgaaatagcccggagtccaacagctcagcgtcaagcagctcgtggtttgtacttacatcattttttttttcagagcaagagtgaaagtttattaaaaagcgttagaacagtaaggaaaggaaaggagagaaaataaggaaagtacaacttggaagagggccaagcgggcgacttgagaaatcaagtgcctgtacttacatcattcttaaccctttcgctcctggagggggctcagcgggatcagggggcccctgaacttcggaacacgcaggacctgggtgtgagagaagagtcccaaagcttggcgtgagcaatgcactcgcggagggagagagcccggggcttgcggggggctcatcacccgctcgtagacaacgggcccccgcaatccctgcgggctccgccgctgctctcaccgctcaaaacggcaggtgcaaaaagcatttgggagccgcttgccagcgcgcggagcctagtctgggaaactccagccaacccaggatcccattttgtagtcccgggcagacccgaaacccctgaaagaactccactccagaagacgccagaacaagttcccacgaatttcatgggcgcccttcacatgaaaacctcagctcccctatcctcaaggaacggggaagggcgccggggagggacttcggtggccagctgtccctgggtcgtgggcgctgtttgctctgcggagcgccagccctgcacacagcggatctgtaagttgcgaaaaggggcttttgggagcgtcagagctttctcactccggtcccccgccgccttgaggctggcagatttataccccacaggtggatggagacctaaacaaaacagtcccggccgctgcctgccgctcgccccccacgtcccccgggcccaccgcaaacttcaacaaaataaacaactcaccacaggcattcccttgtctgcagcgcgacgcttgccagctgggaaaataagccgcaagccacgcggccgaggcgcggagggaaggcagcgcggcgcccgcccctctcccccaggtggggggcagcgcgactcggggcgggagggaggctccgcctcgggggccgctctcccagttctccgactccagaatgagctctgggagaggagctgcgcccttccagctagcccgatttctccgccatctaggggagagggcggggagccaaatccctcagccccccgcaccccagcagcttcctccaggcagctttctccccagtcagcctcaaatagaggtgaacagagaccctcctctccccccggcaacccctatatcgccacactgccccctgccggcgctatccggctcattccggcactgcggacggctgggggcgggcgccgcagacccccgcgtccaggtcctggatcagttctctcttcgccttccccccaccacactcaatcttgcacaaagacgcctttcacgccgccagcgccaccctccgcgccgccctccgggccggcggcgctgccttcgcccacccgcggcaccagccgattcctggtgggcgattgtgccactcgtcgccaggcagggcggcagcggacgcgtgcgggctgttcccactccgcgccccggccaaggcgccagatgcgctgccccccgccacgttctctagctgcccgccggcagccgcagaatgcacacctttctctccgtaaatgatccttaagggtcttccaagtgtttctaaaatgggtacagtggcgggaatggtccgctggactttcgccg

SEQ ID NO: 465032 - DNA, 2230 bp, Homo sapiens
ggagggagctagaacacaaacaaaaaaatcggtgacttataaaagttttatgttttaatcagaaaaaaaatcatgaagtggctgatgacttgtgtaattcacacatccaccctgtttcttgccactggtactctttctccctttctctttgttttcagaaaggaaggaggagacctgaacagtacatccggagaatccagcaaagcatactacggcatgaacgtgcaagtggacagaattaaaacacatgccagaaacactaatggattctaaacaagatgcagtttcatttcctgagcctatacgtgatgtttttaactgttctccagttaatatgtctccatttccagaaatctaacaggagaatctctgactgcttaacagatcacctaagcttgcgatttgtgcaatcctttctagagtaagggctccccggctgctccccggccactgtgtacccaaagcagcggctgaaatagcccggagtccaacagctcagcgtcaagcagctcgtggtttgtacttacatcattttttttttcagagcaagagtgaaagtttattaaaaagcgttagaacagtaaggaaaggaaaggagagaaaataaggaaagtacaacttggaagagggccaagcgggcgacttgagaaatcaagtgcctgtacttacatcattcttaaccctttcgctcctggagggggctcagcgggatcagggggcccctgaacttcggaacacgcaggacctgggtgtgagagaagagtcccaaagcttggcgtgagcaatgcactcgcggagggagagagcccggggcttgcggggggctcatcacccgctcgtagacaacgggcccccgcaatccctgcgggctccgccgctgctctcaccgctcaaaacggcaggtgcaaaaagcatttgggagccgcttgccagcgcgcggagcctagtctgggaaactccagccaacccaggatcccattttgtagtcccgggcagacccgaaacccctgaaagaactccactccagaagacgccagaacaagttcccacgaatttcatgggcgcccttcacatgaaaacctcagctcccctatcctcaaggaacggggaagggcgccggggagggacttcggtggccagctgtccctgggtcgtgggcgctgtttgctctgcggagcgccagccctgcacacagcggatctgtaagttgcgaaaaggggcttttgggagcgtcagagctttctcactccggtcccccgccgccttgaggctggcagatttataccccacaggtggatggagacctaaacaaaacagtcccggccgctgcctgccgctcgccccccacgtcccccgggcccaccgcaaacttcaacaaaataaacaactcaccacaggcattcccttgtctgcagcgcgacgcttgccagctgggaaaataagccgcaagccacgcggccgaggcgcggagggaaggcagcgcggcgcccgcccctctcccccaggtggggggcagcgcgactcggggcgggagggaggctccgcctcgggggccgctctcccagttctccgactccagaatgagctctgggagaggagctgcgcccttccagctagcccgatttctccgccatctaggggagagggcggggagccaaatccctcagccccccgcaccccagcagcttcctccaggcagctttctccccagtcagcctcaaatagaggtgaacagagaccctcctctccccccggcaacccctatatcgccacactgccccctgccggcgctatccggctcattccggcactgcggacggctgggggcgggcgccgcagacccccgcgtccaggtcctggatcagttctctcttcgccttccccccaccacactcaatcttgcacaaagacgcctttcacgccgccagcgccaccctccgcgccgccctccgggccggcggcgctgccttcgcccacccgcggcaccagccgattcctggtgggcgattgtgccactcgtcgccaggcagggcggcagcggacgcgtgcgggctgttcccactccgcgccccggccaaggcgccagatgcgctgccccccgccacgttctctagctgcccgccggcagccgcagaatgcacacctttctctccgtaaatgatccttaagggtcttccaagtgtttctaaaatgggtacagtggcgggaatggtccgctggactttcgccg

SEQ ID NO: 465033 - DNA, 738 bp, Homo sapiens
ctcggggcggtgttggaaatctgaatgtcacccgcggtccggagcagataggatgggctgggaaggtacccgcgaactgccgccggaattcgctggcagctgtgcgaggctcaggtgttctagtttgacatttcccttcctgaaagcggcaaggagaggtctaagagtgggcaaacttcaacgttcggttacagtgtaattaatgagagtggtgggtttttatgcagtgtaattatgccacgatttgttgttgctcagtggctttttcacaaatttctacagattatttaaattttccacaaatttctacggattaattcaatggcagctcactttctccttttatgatcggatgggtccgaaagtgaggaaaaagacaattgtctacaaagaaagaggctgccaagtggagacagaaaagcagttatgagactgatgatagattccaatttgttatcggtaggtgtgaagtggtatctaatctcaagaatgacctcaaggctgagagacacttgataccgccctcgcctttgcctttccccaaacagcacagggttgccatttaaaatccactaacatccaaatcgtagttggcaactgtacccgctatgttactcagaatctctaattaggaatttcttatcaaccacggacatgctgatattccacacatgtttaaatgagctaatcaatggactaggataattgaggggcaaaccttcagtctcaccagctcac

SEQ ID NO: 465034 - DNA, 2536 bp, Homo sapiens
gcaagctcggggcggtgttggaaatctgaatgtcacccgcggtccggagcagataggatgggctgggaaggtacccgcgaactgccgccggaattcgctggcagctgtgcgaggctcaggtgttctagtttgacatttcccttcctgaaagcggcaaggagaggtctaagagtgggcaaacttcaacgttcggttacagtgtaattaatgagagtggtgggtttttatgcagtgtaattatgccacgatttgttgttgctcagtggctttttcacaaatttctacagattatttaaattttccacaaatttctacggattaattcaatggcagctcactttctccttttatgatcggatgggtccgaaagtgaggaaaaagacaattgtctacaaagaaagaggctgccaagtggagacagaaaagcagttatgagactgatgatagattccaatttgttatcgaaaggaaggaggagacctgaacagtacatccggagaatccagcaaagcatactacggcatgaacgtgcaagtggacagaattaaaacacatgccagaaacactaatggattctaaacaagatgcagtttcatttcctgagcctatacgtgatgtttttaactgttctccagttaatatgtctccatttccagaaatctaacaggagaatctctgactgcttaacagatcacctaagcttgcgatttgtgcaatcctttctagagtaagggctccccggctgctccccggccactgtgtacccaaagcagcggctgaaatagcccggagtccaacagctcagcgtcaagcagctcgtggtttgtacttacatcattttttttttcagagcaagagtgaaagtttattaaaaagcgttagaacagtaaggaaaggaaaggagagaaaataaggaaagtacaacttggaagagggccaagcgggcgacttgagaaatcaagtgcctgtacttacatcattcttaaccctttcgctcctggagggggctcagcgggatcagggggcccctgaacttcggaacacgcaggacctgggtgtgagagaagagtcccaaagcttggcgtgagcaatgcactcgcggagggagagagcccggggcttgcggggggctcatcacccgctcgtagacaacgggcccccgcaatccctgcgggctccgccgctgctctcaccgctcaaaacggcaggtgcaaaaagcatttgggagccgcttgccagcgcgcggagcctagtctgggaaactccagccaacccaggatcccattttgtagtcccgggcagacccgaaacccctgaaagaactccactccagaagacgccagaacaagttcccacgaatttcatgggcgcccttcacatgaaaacctcagctcccctatcctcaaggaacggggaagggcgccggggagggacttcggtggccagctgtccctgggtcgtgggcgctgtttgctctgcggagcgccagccctgcacacagcggatctgtaagttgcgaaaaggggcttttgggagcgtcagagctttctcactccggtcccccgccgccttgaggctggcagatttataccccacaggtggatggagacctaaacaaaacagtcccggccgctgcctgccgctcgccccccacgtcccccgggcccaccgcaaacttcaacaaaataaacaactcaccacaggcattcccttgtctgcagcgcgacgcttgccagctgggaaaataagccgcaagccacgcggccgaggcgcggagggaaggcagcgcggcgcccgcccctctcccccaggtggggggcagcgcgactcggggcgggagggaggctccgcctcgggggccgctctcccagttctccgactccagaatgagctctgggagaggagctgcgcccttccagctagcccgatttctccgccatctaggggagagggcggggagccaaatccctcagccccccgcaccccagcagcttcctccaggcagctttctccccagtcagcctcaaatagaggtgaacagagaccctcctctccccccggcaacccctatatcgccacactgccccctgccggcgctatccggctcattccggcactgcggacggctgggggcgggcgccgcagacccccgcgtccaggtcctggatcagttctctcttcgccttccccccaccacactcaatcttgcacaaagacgcctttcacgccgccagcgccaccctccgcgccgccctccgggccggcggcgctgccttcgcccacccgcggcaccagccgattcctggtgggcgattgtgccactcgtcgccaggcagggcggcagcggacgcgtgcgggctgttcccactccgcgccccggccaaggcgccagatgcgctgccccccgccacgttctctagctgcccgccggcagccgcagaatgcacacctttctctccgtaaatgatccttaagggtcttccaagtgtttctaaaatgggtacagtggcgggaatggtccgctggactttcgccg

SEQ ID NO: 465035 - DNA, 2898 bp, Homo sapiens
ataatcccccgccgtgtccctcccttcctccccattggttgtgaccgcacgtcagcccgactcagcctgccaatcgcaggacccagagggccctctcccccgcccgctcagtgtaattcgagttccctgtccatcgactccaagtcctctctcctgcgccgcatgctgcctcgcgctccctttccttccccctctacccccttccgcgatttactgtttcctcgcgcccaacagaaatgggcgaccgcaagtcttactctcgccggcgttacaaaggtaccggcctttgacctctccttgaattaatgtgatccgattcatcttccctccaagttttttttttaatttaattacccctccctgccctcaggtgttctagtttgacatttcccttcctgaaagcggcaaggagaggtctaagagtgggcaaacttcaacgttcggttacagtgtaattaatgagagtggtgggtttttatgcagtgtaattatgccacgatttgttgttgctcagtggctttttcacaaatttctacagattatttaaattttccacaaatttctacggattaattcaatggcagctcactttctccttttatgatcggatgggtccgaaagtgaggaaaaagacaattgtctacaaagaaagaggctgccaagtggagacagaaaagcagttatgagactgatgatagattccaatttgttatcgtacacgggtgctctagattttcctatcaatagagggcgtcctcgagtcattgcaaatcctggtgtcgttaaacggaactgttcttcagaggaaaaacttcatctctataagaaaggaaggaggagacctgaacagtacatccggagaatccagcaaagcatactacggcatgaacgtgcaagtggacagaattaaaacacatgccagaaacactaatggattctaaacaagatgcagtttcatttcctgagcctatacgtgatgtttttaactgttctccagttaatatgtctccatttccagaaatctaacaggagaatctctgactgcttaacagatcacctaagcttgcgatttgtgcaatcctttctagagtaagggctccccggctgctccccggccactgtgtacccaaagcagcggctgaaatagcccggagtccaacagctcagcgtcaagcagctcgtggtttgtacttacatcattttttttttcagagcaagagtgaaagtttattaaaaagcgttagaacagtaaggaaaggaaaggagagaaaataaggaaagtacaacttggaagagggccaagcgggcgacttgagaaatcaagtgcctgtacttacatcattcttaaccctttcgctcctggagggggctcagcgggatcagggggcccctgaacttcggaacacgcaggacctgggtgtgagagaagagtcccaaagcttggcgtgagcaatgcactcgcggagggagagagcccggggcttgcggggggctcatcacccgctcgtagacaacgggcccccgcaatccctgcgggctccgccgctgctctcaccgctcaaaacggcaggtgcaaaaagcatttgggagccgcttgccagcgcgcggagcctagtctgggaaactccagccaacccaggatcccattttgtagtcccgggcagacccgaaacccctgaaagaactccactccagaagacgccagaacaagttcccacgaatttcatgggcgcccttcacatgaaaacctcagctcccctatcctcaaggaacggggaagggcgccggggagggacttcggtggccagctgtccctgggtcgtgggcgctgtttgctctgcggagcgccagccctgcacacagcggatctgtaagttgcgaaaaggggcttttgggagcgtcagagctttctcactccggtcccccgccgccttgaggctggcagatttataccccacaggtggatggagacctaaacaaaacagtcccggccgctgcctgccgctcgccccccacgtcccccgggcccaccgcaaacttcaacaaaataaacaactcaccacaggcattcccttgtctgcagcgcgacgcttgccagctgggaaaataagccgcaagccacgcggccgaggcgcggagggaaggcagcgcggcgcccgcccctctcccccaggtggggggcagcgcgactcggggcgggagggaggctccgcctcgggggccgctctcccagttctccgactccagaatgagctctgggagaggagctgcgcccttccagctagcccgatttctccgccatctaggggagagggcggggagccaaatccctcagccccccgcaccccagcagcttcctccaggcagctttctccccagtcagcctcaaatagaggtgaacagagaccctcctctccccccggcaacccctatatcgccacactgccccctgccggcgctatccggctcattccggcactgcggacggctgggggcgggcgccgcagacccccgcgtccaggtcctggatcagttctctcttcgccttccccccaccacactcaatcttgcacaaagacgcctttcacgccgccagcgccaccctccgcgccgccctccgggccggcggcgctgccttcgcccacccgcggcaccagccgattcctggtgggcgattgtgccactcgtcgccaggcagggcggcagcggacgcgtgcgggctgttcccactccgcgccccggccaaggcgccagatgcgctgccccccgccacgttctctagctgcccgccggcagccgcagaatgcacacctttctctccgtaaatgatccttaagggtcttccaagtgtttctaaaatgggtacagtggcgggaatggtccgctggactttcgccg

SEQ ID NO: 465036 - DNA, 2348 bp, Homo sapiens
ataatcccccgccgtgtccctcccttcctccccattggttgtgaccgcacgtcagcccgactcagcctgccaatcgcaggacccagagggccctctcccccgcccgctcagtgtaattcgagttccctgtccatcgactccaagtcctctctcctgcgccgcatgctgcctcgcgctccctttccttccccctctacccccttccgcgatttactgtttcctcgcgcccaacagaaatgggcgaccgcaagtcttactctcgccggcgttacaaagaaaggaaggaggagacctgaacagtacatccggagaatccagcaaagcatactacggcatgaacgtgcaagtggacagaattaaaacacatgccagaaacactaatggattctaaacaagatgcagtttcatttcctgagcctatacgtgatgtttttaactgttctccagttaatatgtctccatttccagaaatctaacaggagaatctctgactgcttaacagatcacctaagcttgcgatttgtgcaatcctttctagagtaagggctccccggctgctccccggccactgtgtacccaaagcagcggctgaaatagcccggagtccaacagctcagcgtcaagcagctcgtggtttgtacttacatcattttttttttcagagcaagagtgaaagtttattaaaaagcgttagaacagtaaggaaaggaaaggagagaaaataaggaaagtacaacttggaagagggccaagcgggcgacttgagaaatcaagtgcctgtacttacatcattcttaaccctttcgctcctggagggggctcagcgggatcagggggcccctgaacttcggaacacgcaggacctgggtgtgagagaagagtcccaaagcttggcgtgagcaatgcactcgcggagggagagagcccggggcttgcggggggctcatcacccgctcgtagacaacgggcccccgcaatccctgcgggctccgccgctgctctcaccgctcaaaacggcaggtgcaaaaagcatttgggagccgcttgccagcgcgcggagcctagtctgggaaactccagccaacccaggatcccattttgtagtcccgggcagacccgaaacccctgaaagaactccactccagaagacgccagaacaagttcccacgaatttcatgggcgcccttcacatgaaaacctcagctcccctatcctcaaggaacggggaagggcgccggggagggacttcggtggccagctgtccctgggtcgtgggcgctgtttgctctgcggagcgccagccctgcacacagcggatctgtaagttgcgaaaaggggcttttgggagcgtcagagctttctcactccggtcccccgccgccttgaggctggcagatttataccccacaggtggatggagacctaaacaaaacagtcccggccgctgcctgccgctcgccccccacgtcccccgggcccaccgcaaacttcaacaaaataaacaactcaccacaggcattcccttgtctgcagcgcgacgcttgccagctgggaaaataagccgcaagccacgcggccgaggcgcggagggaaggcagcgcggcgcccgcccctctcccccaggtggggggcagcgcgactcggggcgggagggaggctccgcctcgggggccgctctcccagttctccgactccagaatgagctctgggagaggagctgcgcccttccagctagcccgatttctccgccatctaggggagagggcggggagccaaatccctcagccccccgcaccccagcagcttcctccaggcagctttctccccagtcagcctcaaatagaggtgaacagagaccctcctctccccccggcaacccctatatcgccacactgccccctgccggcgctatccggctcattccggcactgcggacggctgggggcgggcgccgcagacccccgcgtccaggtcctggatcagttctctcttcgccttccccccaccacactcaatcttgcacaaagacgcctttcacgccgccagcgccaccctccgcgccgccctccgggccggcggcgctgccttcgcccacccgcggcaccagccgattcctggtgggcgattgtgccactcgtcgccaggcagggcggcagcggacgcgtgcgggctgttcccactccgcgccccggccaaggcgccagatgcgctgccccccgccacgttctctagctgcccgccggcagccgcagaatgcacacctttctctccgtaaatgatccttaagggtcttccaagtgtttctaaaatgggtacagtggcgggaatggtccgctggactttcgccg

SEQ ID NO: 465037 - DNA, 1646 bp, Homo sapiens
tgtgggatcagaccccaaatgaccaactggcagcccacgggccacgtcaggcccacagacatgtcttgtttggcccacaacaagctccctggaggatgccttagccacatgaaagctcttgcagccgtggtggaaaggatcatccacggtgacttgcagctgtactgttattaccaccgtgaaacagctgagaccaaggagggaattctgattgaaagcaaaccagggaggaaagatgcactagcactgacctgtaacaggtcaatctgtgccatggcatggcgagatgaagtggagaacccatgtctcattggaatcccggatcatcgtctccacgaaggctgtcttctgcagcactccagggactcacggctctgggcttattgctcagtgtcatgtgacaagaacctgaaatcagaacctgatttcagaacctgagaacctcagaacctgagccacatcagcttttgccaacaaactccatggttttgttgttgttgttgctgctgctgctttgtttgcttgttctgttgctgtgtaatgaatcttcttgccattggctctttctctgcctttattctagggcatgtccagagctgccactgccctgggcctccaccccacagcccaggaccacaccttaacctggaaagtcgtggacctcctcaggggagctcagggatcagatgggccgatgggtgttactgtggccaggagcactgggtcttgagtatgtgggtggaactttccctcatcccctgaccacgtctaaccacatggcctctccactttgatagtggcgagaagagtagcctcttgcttttgcatgttttcctaatcacagcgtgctttcttgtctgctatttcatttgacttttttcaaccagccgctgaggtggggattattagcacgccctttgcagatgaggaaactgaagcccagggagctttggcaacctgcccaaggtcacacagccagtgaaggaaagggctgaaatcaaaccaggcctgtctgactgcaaggcagggtcttacggctgcctccggtgggtaggtccgggacccagctggtttccgtcctgtggctcaggtgcgaggagagcctccctgggccacctggggaagtctgactgacgtgccagatcctcacagaacaaagcactccctctctcagcaccagggagctcctccaggagcacttcctcccatgtctgtgttcgccgttaagactggacacaccaggatgatctttcaactttgggtccaaaggccctcagtggatgtaaaataggtacatgaggccttgaactgaacatttttttcacttcaccataacctggattttcccagtttaggagcatctgtttgtcttgataacgtttggaacaaagtgaaaaaaactggactttgaagagaacttcagcctcccagcagccctgttttacagatgaagaaactgaggctcaaagagctggagaaggttgttgcccagggtcctgtggagagaaaactcaagctccggctgttccactactctgggacaccacccccagtgggaaccccacttttacaaggattcgaaggtaggtgaggacttatctcctgaaataattagtatacttacttttttgttacatattcccact

SEQ ID NO: 465038 - DNA, 1746 bp, Homo sapiens
tgtgggatcagaccccaaatgaccaactggcagcccacgggccacgtcaggcccacagacatgtcttgtttggcccacaacaagctccctggaggatgccttagccacatgaaagctcttgcagccgtggtggaaaggatcatccacggtgacttgcagctgtactgttattaccaccgtgaaacagctgagaccaaggagggaattctgattgaaagcaaaccagggaggaaagatgcactagcactgacctgtaacaggtcaatctgtgccatggcatggcgagatgaagtggagaacccatgtctcattggaatcccggatcatcgtctccacgaaggctgtcttctgcagcactccagggactcacggctctgggcttattgctcagtgtcatgtgacaagaacctgaaatcagaacctgatttcagaacctgagaacctcagaacctgagccacatcagcttttgccaacaaactccatggttttgttgttgttgttgctgctgctgctttgtttgcttgttctgttgctgtgtaatgaatcttcttgccattggctctttctctgcctttattctagggcatgtccagagctgccactgccctgggcctccaccccacagcccaggaccacaccttaacctggaaagtcgtggacctcctcaggggagctcagggatcagatgggccgatgggtgttactgtggccaggagcactgggtcttgagtatgtgggtggaactttccctcatcccctgaccacgtctaaccacatggcctctccactttgatagtggcgagaagagtagcctcttgcttttgcatgttttcctaatcacagcgtgctttcttgtctgctatttcatttgacttttttcaaccagccgctgaggtggggattattagcacgccctttgcagatgaggaaactgaagcccagggagctttggcaacctgcccaaggtcacacagccagtgaaggaaagggctgaaatcaaaccaggcctgtctgactgcaaggcagggtcttacggctgcctccggtgggtaggtccgggacccagctggtttccgtcctgtggctcaggtgcgaggagagcctccctgggccacctggggaagtctgactgacgtgccagatcctcacagaacaaagcactccctctctcagcaccagggagctcctccaggagcacttcctcccatgtctgtgttcgccgttaagactggacacaccaggatgatctttcaactttgggtccaaaggccctcagtggatgtaaaataggtacatgaggccttgaactgaacatttttttcacttcaccataacctggattttcccagtttaggagcatctgtttgtcttgataacgtttggaacaaagtgaaaaaaactggactttgaagagaacttcagcctcccagcagccctgttttacagatgaagaaactgaggctcaaagagctggagaaggttgttgcccagggtcctgtggagagaaaactcaagctccggctgttccactactctgggacaccacccccagtgggaaccccacttttacaaggattcgaagctttactccattctttgccacacataaggaggccgaggagggaagatggcatgaggccaggaattcaaggctgcagtgagatatgattgcaccactacacttcagcctgggcgacagggtgacacctcatctctaaaaaataaaataaaataataaaaaaatt

SEQ ID NO: 465039 - DNA, 1255 bp, Homo sapiens
ctatattagtttgttctcatactgaaataagaactacctgagactgggtaatttatgaagaaaggaggtttaattgactcacagttccacaggctgaacaggaagcatgactgggaggcctcagaaaacttacaattgtggcagaaagcaacggggaaagccaaaccatatcactcactgagaggtgacaacgtgctagcagccctcgctggccttcggagcctccttggcctgggcgtctgctctggctgggctcaaggagcccttcagccggccactgcgctgtgggggcccctctctggggctggcagaagctggagccagctccctctgcttgcggggaggtgtggagggggcggcgctggtgggaaccggggctgcacgcggacctcgtgggctgacacaggttcctgcttcactcctgaggccagcgagaccatgaaccccctggaaggaatgaacaactccagacgcgctgccttaaagagcctaacactcaccgcaaaggtctgcagctcccctcctgaagtcagcgagaccatgaacccaccagaaggaataaactccggacacatcggaacatctgatggaacaaactccagacacaccatctttaagaactgtaacactcaaccaggactgaaaggagactttagagaagagctgacagaagagattcattctaggatctctccattctcaccacaccatggacaagcctagttccatgtgcaacattcagtattggatgatctggattcagtacagaaagcctggacttttgagcctaaacaggatctgaagcagaaggatgaaaaacagatcaaccaacaacaagaatcaaccatcttggtttctcatttgtcaataatgggcaatagtcctgcccacatatcagggaatgtatatgccataattaaatactaatgcttctatcttctctagagaatttgttcctttatgtgaaaaatattatttcttcttaataagcaatgtatgacaattgaggaggcataaaaattagagaaaaataaaaaggaaaatgtctgtagttgcacattatatcataagtaatctgcattttattgtttttgtgatactctagaaatggatatgttttagtaaacctaatttaactcattaatccatctggaatttcctttgtaatattttataaaatgtgaatcgagactgataaatgttctaaatagtcaaatttgctaaaccttttataaactgttttcctttatattta

SEQ ID NO: 465040 - DNA, 2965 bp, Homo sapiens
tgactaactcatcagaactaaagccagaaagtagagatgatcctttctagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaagaatctctggataacaacttggaagctttgaagaatcaacttagacagttggagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatctgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcagacttgttattatgtttttgatctgagaaatgtctttgtgttttggatacatagccgatagatactagtatgagaaagtctaactgatattttaatattctgattatgaaaaagtaccaatgctagattgttatgtaataaaagtgaactgttagtttactgcttactgactagtttctacttgctaagcaatggacctttggttcccacagtggtgtttggtt

SEQ ID NO: 465041 - DNA, 1855 bp, Homo sapiens
  misc_feature (1830)..(1830): n is a, c, g, or t
tgactaactcatcagaactaaagccagaaagtagagatgatcctttctagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaagaatctctggataacaacttggaagctttgaagaatcaacttagacagttggagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatctgcagcagatgaggtggtgtntcgcagatgaggggatcctctagga

SEQ ID NO: 465042 - DNA, 880 bp, Homo sapiens
tcttaagggatgaatacttgttatctggggagacaagattctcagttaatgacatgcctgagaaacagtcagcagctggttggtggagagagaaacagactggatcttggaggaccaggcttaatgtggatttcgtattgtagaagaagaagcgcctctgagggatgtgtccccatgaccacgtctgacagtatgatgggcacaccaggagtccagacagattcaacagttcagctttgctcaggagaagaggagctgtggtgttcccagtccatcggccacaacactctgatgaggggcttccacctgaagcacatcgtcagtgtggtgacagtgggatttgtgctcactcgcacatgccagaagccataccagggtgcacacacaactctgggaagcaacactggtgggggtgttgctgaattcaatttcatgaaggcaggggtttccatctgcttccttcaccactgcatccccaacatctaaaatgatggcagccacaaaaagactcctcaaaatatcacttgttaaataactgaataaatttgttaaataaggtgatgtgaacatattcagtgacagaaactaagaggccagagcataaaacagaagttccaggtctttaaagaagtaattagcatagattggggccccaatctaataggactcgtgtcctgataagaagagacaccagggccatgggtgcatagagaaaaggccatgtgaagacagaggcggaggacagccacctgcaagccaaggaagagaccttcaaaaaaaccaaatgtactgatactttgtgcttgaacttccaacctccaggactgtgagaaaataaatttctgctctttcagtcacttaatttgtcatattttgttat

SEQ ID NO: 465043 - DNA, 1436 bp, Homo sapiens
tgcctaactgcatcgctaaatgatcccgagccctcgtggcctgaattggatcgttcccacagcttcagaagtgcactggtctaaacatgtctgtttaggggtctgccttcccctccagattggttggttcttgaggggtgtgggcagcggaggggcctggctggggctggaaccctccacataggcacaggtgcccggactctctccagcaagaagcattgcacagacagaggacgctgtttcccagttgaaaggtcaccaagggacagggtgatctgccaggcagttcctgagcttgctcttgggacggccttttgggggcaaagcactttggagccagaagcaacccctgcctgggctgaggccctgtgggcctcgctccacgactgtcacaccttacccaccactggagagatggccgctgcccgtggactccctggcagccatgtggttgcccagcccagggggccttcagaaaggtgaccttgcaccggccaaggcccgtgggcaggctacgctatggcctgtagatcttaatgacgtccttgatgggccgccggcagatggggcagcaggcccgggcctgtcgcttgagccgcaggccgcagctgtggcacaggcacatgtgtccacacgtgtagatgaccgtgtccacctcgccatcgaagcacaccgtgcactcgccattcttgatgcctgccggctccggtggggagaacacgggggacaccggggggctcagcggggagctgggggccgtcactgccgaaagggagaagaggacatatgttaacaatgtctctctcagggatgactcagatgccgaggaggactggttgacactgaaggtcatatctgaatcactatcgtcctgggagccgctgagggaccctgatggagtcgtggtcgcagggctggactgcagggtacctgaggcccaaagagattccatcaggggcagtggaaggaaagaaggaactcattccattcattgggaaggaagcctggagctggaagagccaacccgtggcaaaggcctgcctgagagtgatgccaacacagaggcaagcagagctttgagttggaaagagaggtaggatcctgctgatatccttccagtacctagatccagctattcctgaactcacccaatatactcccagacatttccttttttgcttagggcactttgagtggggttttgccccttgcgagaagatccctgactactagtgctcaacatggatgagttttcttccccaagcttgctgttggttcagacaataacagcttgtttcttaggatgaaaagatgccccttcccttgccctacctgaggatgaatggacagataatgggcacttcgtctcgggctgaaatgatgactatgtctgatggttcctcaaaaacacaaaacaacacaacttccccctcccc

SEQ ID NO: 465044 - DNA, 3470 bp, Homo sapiens
attttcaaacaacctatacacagaatactgctcagctaaaggtggaaacggaaaagacagctgcctacacagtgaaattcgaaaagcctcaagatgccctcctgccagtctgctacagtgcctggaaagcaacaactatagtcattcagctgtgtccttaagagacctttcttaataagaaaaggaggtgacatgtttatccatcacagctctgtcttaattaaagatattctggttgcaggccagataacttttacaaagccaaccacagaaaagtttacaaaggatgtagtggatagtgtgattgctgttctcttctcatctgaaaaagggcaaaacaagcaggtcacttcaaaagtcactgaacaaatgcttaattgccttctggaggatctctgtagaagaagagatcaggcatcccctcccacaggtgttcacaggaaatggtgccacacatgtgcagaagtttccaggccagcatccaccacatcaaacccactgagtgagctcccttcttgcatgggatggcaatgtccacatagcacagcggagaatctgtattacgtggagcaatgtgaagattccaggagtgaagcggccagcaattggagtggctccagtggcagcagcaaacttcagtatggccctctggccagtattcctggaggatatgacgcggacatcagcagggttttcaatggcaacaatggcacaagctgccaacagaagcttctcccaggtcctcttcagatttatgatatagacgccgacatcaagggctctgtacactgtaaaagtttccctttaagttacaacaggaatctagaacatcgccatatggacccctctctgggtagcacaaaaaagcccattctctagttgatagatatttgggttgtttccaggatttggctattatgagtaaaactgctatgaacatccatgcataagtctttttgtgaacataggctttcatttatcttgggtaaatgaccaggagtggaattttagatcacttagaaagtatgtgtttcactttataaggcactgtcagactgtgttactaagttgatgtaccattttataaatccaccagaaatatatgagcagaccagttttttaaaatctttgccaatccttgatattgtcaataatataagtttaaaaaggggaacaataaaagtactagacagaaatgtagaacatattttgtaaaaacagaataagagaaattgtttctaagtgatagttgaaagcttgatgtcataaagaaagcttgactccataaaacataaaataactacatgacaataataatgtcaaatgagaagagaaaaaaatgtctaaaatatttgtcggacatattaaatatattaatgtccttattttttaaagagctcttataaattaatatgtaaaatacatcgatccagcaaaggtgaagagcaggcagttcataacagaaagatattttaaaggtgtataaagttgtccaatttcactcaaaattattgaaatatgaattaaaacaaaatatgtcatacttctatcaaataaaaagatgatttttggctatgtactgtgttggcaagagttttgggagaaagagcttctcatacactgttattggctatattaatttgtattttcccattggaccacagtttactgtatacacagtgctttgggaagtactctcttaaatgggtttttcttctgctctcacaccaccacaataataatcaacacagaagaagacttctctgaccaaaagcttgcttctgagccctaaatttctccaacattataaccaagattgtgacaatgattatgaaagttacgaactaggaaccacagatggaaatgaatcataatatcacacaggcattaggatttaatgttgaatgtttataaagtgtattttacatatattgcctaaatttatactaccaacaccacaagaattagttattttatattctcattttaaaaataaaaaacctagagtttagagagatgccttatccagtcaggtcatataactagtaagtggcatagcttggtatagagcccttaactttgaatttcaagttcagttacattttcattaatcagagttgacttaccttgaaacacatgtgttttgtacatcaatgcatgtcactatttcatgcaatgaatgtaaagatgctacattttattacctagataatgtgctggttttgtcctatttctaagtttgtagaattgctgtagaaatattgagaacattccttttttttccttattaaaatcttgaagaggtgcttttatttttatttatttttgtctgctttcaggacatgttttaaaatctatcatttggacaatttgggttaataatctttgttttagtgttttaaagaacagcctcagtgaaaatgctttattaacgtgataaatgataagtttaaataaaataaatgaaaaaagaaagtgtggttttgaaataatttatctggcacagcaccagattttgagagagttaattattacaagttgctgaacattactgcaattttcacatggaaatatttgcctctcctatttccttgtgttattgaagacatattatgaaagccataatatcagcagcttgcaatttggaactcatttgatttaactgataagaatctttttcatttcacaaaacataacttcactcagaaatataaaactgttctgctgtattaaacagtgaataatatcaggataacaatgttaattggcttttggactgggagtatttgaatgaactctcttctccatcatttttccattagattttgcttgaattactcaaaaaaccaaggtatttatcctgatttgtaacacaatacaacatttctctgataagtgttttcacatttttagaaattctctgcactgtaaacagacagagaaaaacaacaactactataagaaaacaaaacaaaacactaaagctactctagaatgcatgttgagctggatggccattaaacatttgttcaatattcaatgataatcttcatgtcaaatagatcagatagggcattaggttatattaagataaaagaacacagatgagtttgggagccaatcctgttcagacttgaatactgactgcttttgcagtctcccctcttgtggcaggattgggtactggttaatgatgtgaattctgccctaaagtcacctttctttggccaccttctagctgtgtgatttagtgaagactaacttgctttctgtacttcaattttctcatctgtagaataaaagtaaccacctgcacacagagagagttttaagaattaaatgggataaccaagagagtgcctagtccagtgtgtggaacataacaaatattaaataagcattcattttcttttttccccactcctttacttctcctttgccttccctccagctatgaaagttttcagctc

SEQ ID NO: 465045 - DNA, 471 bp, Homo sapiens
ctctttttatttacacgggagcactccacagtgttttgcagctttcctatttcactaaactacagcccattctgctcttataagtagcagcgttgccctcgattggctgcacccgagttctgaccctcctcctccagcgagggcctcggcagccagcaagatgggctcccgctcccggaatggactcggaaactttaactgcggctccacctgctggtgtggattaggacaaaggcggagaacaaacctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaaggttacgtgaagacaaacaaagc

SEQ ID NO: 465046 - DNA, 646 bp, Homo sapiens
aattcgcggccgcgtcgcacacggctgacgagaagacgacagaagctgatcctggttttgcttgataccaagaatgaagactgggatcgtatcatttcctcctttatcttagaaaataaaggttacccaagcaaatcagagaagctctggagcatggaaaagatgaaaacctatttctgcctcataaggaatctgcagcccacactgtctgatgtgggcaatcaggttcttctccggtactaccagatgcaaaggcagagtgattgccggaacgctgcccggaccaccattcggctgttggaaagcttgatacgattagcagaagctcatgctcgcctgatgtttcgtgatactgtaactctggaagacgctattacggtggtgtcagtcatggagtcctcaatgcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaagtgactgcgaacaccacccccaccagcattttagtgttcacttttctgggtatcagacattcaggcaggctcggtggggatagcttgtctttg

SEQ ID NO: 465047 - DNA, 813 bp, Homo sapiens
ttttttgtttctttcgtgtttagaaaaaaaatcaaaacaaaatgagtgaatacacagaaatgaattgtactgtctctcctggcagcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaaggttacccaagcaaatcagagaagctctggagcatggaaaagatgaaaacctatttctgcctcataaggaatctgcagcccacactgtctgatgtgggcaatcaggttcttctccggtactaccagatgcaaaggcagagtgattgccggaacgctgcccggaccaccattcggctgttggaaagcttgatacgattagcagaagctcatgctcgcctgatgtttcgtgatactgtaactctggaagacgctattacggtggtgtcagtcatggagtcctcaatgcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaagtgactgcgaacaccacccccaccagcattttagtgttcacttttctgggtatcagacattcaggcaggctcggtggggatagcttgtctttg

SEQ ID NO: 465048 - DNA, 1345 bp, Homo sapiens
gacgttgcctcatgctctttttttcttttcttttgctgattttgctgcgtatccctttgctgtaagagatcacagccatgcatacagccatatgctgagtgcttgagcctgacactagacatggaaaaaaaaatacaccctctcctaccttccacctcatgggtttccctctggtggcggcgtacactttggactgcctccttgcactgcaggatgagatccctctttggggcgaaggtgggcacaacaggacaggaatctgtaaattcattgaggaccccaccctgagcctcaaccccagctttgcttactggaggtgctgcccctcggagttagggatgcttgccagctttgtcctgaagccagaaacacccttgctgagattcccacccatcactttctgggtctcttattacatttcctgggctcagctgtcttatctggaaacgagaatcctaatagccaccttgaagcacggatgtaaggaggaaatgaaatcattgtgtggaaatgccaagcccagcgcctggcatagagcaggtgcccagagaccaaggatctgggagaaggaacatgccttaggatctaaagtcttgttcctctccctgtcccatagttcccattgaacctcttacaggatggagaagctgaggccttaactcacaaggttgtgcctttataaggcaacaaagcaaaagcaagtgtgtcatagatggaaacctgtttacctagatctcaccgacctgttgagaggaaaggagccaacctggcctggtgaccttctctgtgcaagcagggagcaggcacacaccaccaatgagtgaagaaggctgctgtggcatgctcgggacctagagggaacctgcctcattgacaggggacagcagctgcacagctccagacaatcgttgtcaaggacgggaatgagattctaacatggctgatctgatttttcaagaaagatgagaaaaatagtaatggaggaaatggaaggaaaaaggatggccataagttggaggcaggtgaaagacccaaattcatggaagagaagtgagtcacacagggagccagtggcagagccacaccccacagagcaatcaacatgctctactctgcagacctgcaacagggagggaagccagactctgatgcaagaaggaaagaccatgtgctggctcagtgtgtgcagcctggactgagctactgaactctaaatccaaggatgactaataggcagaatgacattaataccagacctgatgaagacagcacaaaaagtaaatctcaacacaacctcacaatattaataaagcaaaaattttaaatacagtaatgtattagcaaa

SEQ ID NO: 465049 - DNA, 1318 bp, Homo sapiens
gacgttgcctcatgctctttttttcttttcttttgctgattttgctgcgtatccctttgctgtaagagatcacagccatgcatacagccatatgctgagtgcttgagcctgacactagacatggaaaaaaaaatacaccctctcctaccttccacctcatgggtttccctctggtggcggcgtacactttggactgcctccttgcactgcaggatgagatccctctttggggcgaaggtgggcacaacaggacaggaatctgtaaattcattgaggaccccaccctgagcctcaaccccagctttgcttactggaggtgctgcccctcggagttagggatgcttgccagctttgtcctgaagccagaaacacccttgctgagattcccacccatcactttctgggtctcttattacatttcctgggctcagctgtcttatctggaaacgagaatcctaatagccaccttgaagcacggatgtaaggaggaaatgaaatcattgtgtggaaatgccaagcccagcgcctggcatagagcaggtgcccagagaccaaggatctgggagaaggaacatgccttaggatctaaagtcttgttcctctccctgtcccatagttcccattgaacctcttacaggatggagaagctgaggccttaactcacaaggttgtgcctttataaggcaacaaagcaaaagcaagtgtgtcatagatggaaacctgtttacctagatctcaccgacctgttgagaggaaaggagccaacctggcctggtgaccttctctgtgcaagcagggagcaggcacacaccaccaatgagtgaagaaggctgctgtggcatgctcgggacctagagggaacctgcctcattgacaggggacagcagctgcacagctccagacaatcgttgtcaaggacgggaatgagattctaacatggctgatctgatttttcaagaaaggtgaaagacccaaattcatggaagagaagtgagtcacacagggagccagtggcagagccacaccccacagagcaatcaacatgctctactctgcagacctgcaacagggagggaagccagactctgatgcaagaaggaaagaccatgtgctggctcagtgtgtgcagcctggactgagctactgaactctaaatccaaggatgactaatgtaagcctaaagggtaatctgcaaatactgctccattaatattcaatgataaatgatattgctttagaatcaaattcacataaacagaagcttcagctgtatgtccgcaccctgggaacattaaattgtaagccacgtcttgtaaat

SEQ ID NO: 465050 - DNA, 1285 bp, Homo sapiens
gacgttgcctcatgctctttttttcttttcttttgctgattttgctgcgtatccctttgctgtaagagatcacagccatgcatacagccatatgctgagtgcttgagcctgacactagacatggaaaaaaaaatacaccctctcctaccttccacctcatgggtttccctctggtggcggcgtacactttggactgcctccttgcactgcaggatgagatccctctttggggcgaaggtgggcacaacaggacaggaatctgtaaattcattgaggaccccaccctgagcctcaaccccagctttgcttactggaggtgctgcccctcggagttagggatgcttgccagctttgtcctgaagccagaaacacccttgctgagattcccacccatcactttctgggtctcttattacatttcctgggctcagctgtcttatctggaaacgagaatcctaatagccaccttgaagcacggatgtaaggaggaaatgaaatcattgtgtggaaatgccaagcccagcgcctggcatagagcaggtgcccagagaccaaggatctgggagaaggaacatgccttaggatctaaagtcttgttcctctccctgtcccatagttcccattgaacctcttacaggatggagaagctgaggccttaactcacaaggttgtgcctttataaggcaacaaagcaaaagcaagtgtgtcatagatggaaacctgtttacctagatctcaccgacctgttgagaggaaaggagccaacctggcctggtgaccttctctgtgcaagcagggagcaggcacacaccaccaatgagtgaagaaggctgctgtggcatgctcgggacctagagggaacctgcctcattgacaggggacagcagctgcacagctccagacaatcgttgtcaaggacgggaatgagattctaacatggctgatctgatttttcaagaaaggtgaaagacccaaattcatggaagagaagtgagtcacacagggagccagtggcagagccacaccccacagagcaatcaacatgctctactctgcagacctgcaacagggagggaagccagactctgatgcaagaaggaaagaccatgtgctggctcagtgtgtgcagcctggactgagctactgaactctaaatccaaggatgactaataggcagaatgacattaataccagacctgatgaagacagcacaaaaagtaaatctcaacacaacctcacaatattaataaagcaaaaattttaaatacagtaatgtattagcaaa

SEQ ID NO: 465051 - DNA, 1321 bp, Homo sapiens
caacagcttctgcaatggcgtcacgttcacgcagcggcccatccggctgtacgagcaggtgcggctgcgcctggtggccgtgcgcccctggctggagcggcgcgctgcgcttcggcttcaccgcgcacgatccgtcgctcatgagcgcccaggacatccccaagtacgcctgcccggacctggtcacgcggccgggctactgggccaaggcactgcccgagaacctggcgctgcgcgacacggtgctggcctactgggccgaccgccacggccgcgtgttctacagcgtgaacgacggcgagccggtgctcttccactgcggcgtggccgtgggcggcccgctctgggcgctcattgatgtctacggcatcaccgacgaggtgcagcttctggagagcgccttcgctgacacgctgacgcccgcgcgcctcagccaggcccgcttcagcgcctgcctgccgcccagcagccacgacgcggccaacttcgacaacaacgagctcgagaacaaccaggtggtggccaagctgggccacctggcgctgggccgcgccccgggcccaccgccagccgacgccgcggccgccgccattccgtgcgggccccgtgagcgcccgcggcccgcgtcgtcgccggcgctactggaggccgacctgcgcttccacgcaacacgcgggcccgacgtgagcctgtcggccgaccgcaaagtggcctgcgcaccgcggcccgacggcggccgcacgctggtcttctccgagcgcccgctgcggcccggcgagagcctcttcgtggaggtgggccgtccggggctggcggcgcccggcgcgctggccttcggcatcacgtcgtgcgacccgggcgtgctacggcccaacgagctgcccgccgacccagacgcgctgctcgaccgcaaagagtactgggtggtggcgcgcgccgggcccgtgccgagcggcggcgacgcgctcagcttcacgctgcggcccggcggcgacgtgctcctgggcatcaacgggcgtccgcgcggccgcctgctgtgcgtcgacaccacgcaggcgctctgggccttcttcgccgtgcgcggcggcgtcgcgggccagctgcgtctcctcggcgctgcaccgcccgaggccagcccgcggttcccaactttaagcgcccgggcacgatccaccccgtccaaaattgccggactccaccccagagttccggattcagtgggtgcacggtgcgccccgagaacgtgcatttccgacaagtgcccggagatgctgacaaagtggaatggaggcctgaaccatcctattttgagataattttt

SEQ ID NO: 465052 - DNA, 753 bp, Homo sapiens
atcacagtaaaacatggtgggaatgaatttggcaagcaatagtctaaggagggttgtattcctatggcaatatcaaggctgcaaaggagaatgtgtccccggtctagtccaagtccacctggaggcttgggttccatctgggactgaatctagaaagatttgctattatgctctaaaaggaattgtaattaacaccaaattctatgccaggcaaccacgcccctaccctggtagaggactgaagagacactcttggaaagggtttggaaccaagtattctctggactcagggacaccagacaactcttgggcccggactgggggacatctcagaaatgaggtttcagtgaaagcctgcacaccaacaataagaatcccagacccttctccagttggctcccaggatactggtagagaagtttatattttgcaggcagaagatggaaggttttctctccaagggaaatgatgagcccaagaagaaaaagacacttgagggaagctgcaacatgaaaaactgtcaaggaatagcagcacactcacaacaaacacccttcgaagaaaacccaggaagacccatgcaatagattcctgggactcaacttagaaggcatggtggtactcttcactatttgtctgcagtgatttgtggaataaatctctcacttttcctaaccctactttcttttgttattaaaataaaagtaattattctcatgcacttgcctcagagaaagccgtgagcacatactt

SEQ ID NO: 465053 - DNA, 894 bp, Homo sapiens
acttctgcccatcccaggagaaccacctgtgtcttctcactgccagacctctcttcctaatgacctagaggcactcctggcacctctctagcaaggtcctgtgttgaccgatgtggacagaggggcagtgggacatgtctggggacatgtggtttctcagcaggcagggacctcctcctcctctttgccctcatggaaaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggaggaaaaaccaggccatgcagagacaggagctgaagggacacgagaagactctgctccaccacctcttgtggaaggcctgacatcagtcaagcctgcccgcagccatccggaggcctaaacgtctccctgtgatgctgtgcttcagggtcac

SEQ ID NO: 465054 - DNA, 774 bp, Homo sapiens
  misc_feature (44)..(44): n is a, c, g, or t
cggccgccagccccgcgttccttctacgcctcccgcttctgctnctgctgtccagctggtgcaggaccgggctggccgaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggaggaaaaaccaggccatgcagagacaggagctgaagggacacgagaagactctgctccaccacctcttgtggaaggcctgacatcagtcaagcctgcccgcagccatccggaggcctaaacgtctccctgtgatgctgtgcttcagggtcac

SEQ ID NO: 465055 - DNA, 398 bp, Homo sapiens
tactaggccacgtgcaagggctggttggggactccaggggttgagagcatcctctggacaacatggaaaaagaaaatgaaaatggtgacctcagccctatagctagaaggaattgaatcctgtcaacaacgatactcatcactcacttcagatgttactttaagacattctggagcagcgtcatgtgcaggaacaataaggaagtgagtgcttttgtaattcctgcacaactgtatcttacacttactaagggattcatgggcaatatgactgaataggaacagctccagtctgaagctcccagtgagaccaacatagaaggtgggtgatttctgcatttccaagtgaggtacccagctcatctcattgggtctggttaggcagtgggtgcagcccac

SEQ ID NO: 465056 - DNA, 814 bp, Homo sapiens
acagcttttggactcttggacttataccagtggtttggtaggggctcctccacccatggctaaaaggggccaagctacggcttgggccatggcttcagagggtgcaagcctcaaggcttggcagcttccacatggtattgggcttgcaggtgtgcagaagacaaaaattgagatttgggagcctctgcctaaatttcagacgacgtatggaaatgcctggatgtccagagtccccactggggcactgcctagtggagctgtgagaagagggccaccatcctccagatcccagaatggtagatccaccaacagcttgcaccttgtactgggaaaagccataggcactcaacgccagtctgtgaaagcagccatgggtgctataccctgcagagccacagaagcagagctgcccaaggctgtgggaggccaccccttgcatcagtgtgccatggatgtgagacacagagtcaaaggagattcttatggagctttaagattaaatggcagccctgctggattttggactcacatggggcctgtagcccctttgttttgactgatttctccttttttgaaagggagtatttacccaatgcctgactctatgaacaataaggaagtgagtgcttttgtaattcctgcacaactgtatcttacacttactaagggattcatgggcaatatgactgaataggaacagctccagtctgaagctcccagtgagaccaacatagaaggtgggtgatttctgcatttccaagtgaggtacccagctcatctcattgggtctggttaggcagtgggtgcagcccac

SEQ ID NO: 465057 - DNA, 1403 bp, Homo sapiens
gctcctcaccttccagactgggcagccaggcagaggggctcctcacatcccagacgatgggcggccaggcagagacgctcctcacttcccagacggggcttcgagcagctacgttccgactctttcctcagcttctcatgacactgcttatccagattcatcacagcatcggcctcaccatgtctgatgtcgacatcccaagtggcctgtacacagaacaggaagtgccttcagagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggatgtggatcaggaagagatcagtcctctagagttccttccttccaacccagagatgccacaaggacagaaaacaaacactgatgtactccaagaacccaaaacttcccatcagaagatcagcagtcttgtttgccttttatcgaagtacatggatcacaatgagctcaggaggatgggtactgactggatagaggacgatctcaggggcttttacctccaacctgtgtttgcctaccgctagatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgttagtatgtctgcttaatt

SEQ ID NO: 465058 - DNA, 842 bp, Homo sapiens
tagcgcctggctcagaatagctctgaaacacagaaattcagtcctgccaaaaccgccagtctttccctcttggtcaccatccaggactctctgcgccccgttccccacaacatgcttactgagcattcctgggtggggcagggttggggggagggggactggggacttatgttaaggagagatgagttagtggcaatggagagtccattagtcatttgaagatcccaggggtggctgggcggctcccttaattaagtcaacagcagccttgttctacccagtaaataaatagtcaatgactctattgtgcatcctggagcgggcagcacagacgcgtgaccggttctgggcgcctgggctccagctgctgtgacctgcagcctaatgggccctcgaggcacagccgagtttgggccaggctccgaaaaaatgccccattctgtcccattcctccatgggagtaaggaagataactttaatcccctgagaaaaggctttggagccagaaatcagaagaagctttctcttagagaaagccagcttaaaaaaggatcacacgggctgctctatcagggttgctatggcctagtgtggatgtgcactgttggagagtacacaacagagagccctcagatggaaccaatttgccaacaacttgattttggacttttggcctccaaaactgtgagaaaacaaattcctgttgtatcagtacacagacatacagtggtttttctttttgtcaaagaaagtgctacaatttctaaagctgcccattgagtgtttctgagccatagccaagagctatttcaaaatgaggacagatttcttttctccctggg

SEQ ID NO: 465059 - DNA, 1357 bp, Homo sapiens
gagaagaatccccagcggtcactagaggccttgacgaaagagatttccaggagactcagcatagatgttgaatcttcctattggaggagaagctcccgactcccttctagtcatggcagagcacggaattcagaacaattctactggtgaggacaaggcctctattgtagtcagagtcctctcaaaggacaaaagcagatatggctgccttggatcagctgcacgcagtgcactcccgacctggccgctggaggcgcggctcccatcacctgcaccgcgactgctagggactgtcaaagcggcagcatgccatcgccttctccagcccttctccagcagcacaaccagtcctcccagctggtcctctgaggaccagccgtcatggcgacgtggtggcaatgtccccaggcagccgaccatcctgggcttctctttggacaggcctgggccaggaccttaggggatctctgtgtccatggtataaatctgaatgagatcagacacaatattatcaatgattggcttggtaaggtcttcaccaaacacctgccaccacggcttctcagccttaacctcggcgggcacctcaactccgtagacctgcagggccagctgtcccgcaacagggcccaggcagtgacggcaaccggggtccgctgccagctgtggcggttcagagtttttgagggaaaccaggtagtggagcaggtacttgtgtggaagctggaaggagacctggaagcgcagaactctcagcatgagaagctcacactgcacaatgctgtcccggagctcccagaagcgggattccaattccaggggctcaccgctcgggttaaagtacctgttggacacattgatgatgtcatgagtccgcaggtgctgcttttccgctttgccggccaagtaaatggaagacacggcaatcagcttgacacctgcctccatgatgaacctcgccactcggaagtgcaccctggcttcgggcgccggttgcccctcggggccccgcgctgcaggcccccctccgccgccctccggggcttccatgaggcccggcggccccggcggaaggagaggctgctttgcgcgcagaggccagcagagcggggggggggcagccgctgtatttttccactgcgtggatcacactggagattaattttggttcagccagtgcctgccaagcagaaagcgaaggccctagcccacggggaagtcagccatggcatctgtcacagactcgatgtcgctggtacatttccacggagagagatatttacaatagtaaatttctaggctttgataaaaacactgggtacgatttgttttgataggcatgaacatacttgtaatc

SEQ ID NO: 465060 - DNA, 1950 bp, Homo sapiens
gctggagacagtgaggagaagaaaggggcgggacaagggcaaaggcgttagaagtcaccaccgacccagcccctcaacagcaagttggttcttcagcattaagatccaggtgtcagcctatgtctttatattgtcaagatgtctctttctaagaagttgactttagacaaactggatgttagagggaagcgagtcatcatgagagtagacttcaatgttcccatgaagaagaaccagattacaaacaaccagaggatcaaggcttccatcccaagcatcaagtactgcctggacaatggagccaaggcagtagttcttatgagtcatctaggtcggcctgatggtgttcccatgcctgacaaatattccttagcacctgttgctgttgagctcaaatccttgctgggcaaggatgttctgttcctgaaggactgtgtaggcgcagaagtggagaaagcctgtgccaacccagctcctggttcagtcatcctgctggagaacctgcgctttcatgtggaggaagaagggaagggccaagatccctctggaaagaagattaaagctgagccagataaaatagaagccttccgagcatcactttccaagctaggggacgtctatgtcaatgatgcttttggcactgcacaccgcgctcatagttccatggtgggagtgaatctgccccataaagcatccggattcttgatgaagaaggaactagattactttgctaaagccttggaaaacccagtgagaccctttctggctatacttggtggagccaaagtggcagacaagatccaacttatcaaaaatatgctggacaaagtcaatgagatgattattggtggtggaatggcttataccttccttaaggtactcaacaacatggagattggtgcttccctgtttgatgaagagggagccaagatcgttaaagatatcatggccaaagcacaaaagaatggtgtaaggattacttttcctgttgattttgttactggggacaagtttgacgagaacgctcaggttggaaaagccactgtagcatctggcatatctcctggctggatgggtttggactgtggtcctgagagcaacaagaatcatgctcaagttgtggctcaagcaaggctaattgtttggaatgggccgttaggagtatttgaatgggatgcctttgctaagggaaccaaagccctcatggatgaaattgtgaaagccacttccaagggctgcatcactgttatagggggtggagacactgctacttgctgtgccaaatggaacactgaagataaagtcagccatgtcagcactggaggcggtgccagtctagagcttctggaaggtaaaatccttcctggagtagaggccctcagcaacatgtagttaatatagtgttacttccttctgttttctgtccatggcccttaagtcagcttaatgcttttacatctcgatgtgacttttgttaaaatctactcctagatcaagacctatgtaatggacaagcagcaggccatcaggaactcttaatatcagcacagcaattcattttagtttggtcacgcatttgcctgttcaagttctcatttgaacttcaccattgtgctatctagggaggacatattcttaagttgcctattaaagaaagtgagctgaagaaactgaatctttttattttagtccaactttgctattgtttcataatttgaaacccaaaagataaaacttaatttgttgggaaagggtggaatgaaagttgacaaacaaacaataaatatgcccaaataaactgagaaaaataattacatataaagaactcatgggtaccattaaagttctgctaaggggaaatgttatactaaataggaccaaaaaaaagagaaatgaaagacacttattaaacccaaggaatttttaaaaagaaaagaaattaaactcaag

SEQ ID NO: 465061 - DNA, 1952 bp, Homo sapiens
  misc_feature (25)..(25): n is a, c, g, or t
tgcaggctggtacccccgggggtantggggcgggacaagggcaaaggcgttagaagtcaccaccgacccagcccctcaacagcaagttggttcttcagcattaagatccaggtgtcagcctatgtctttatattgtcaagatgtctctttctaagaagttgactttagacaaactggatgttagagggaagcgagtcatcatgagagtagacttcaatgttcccatgaagaagaaccagattacaaacaaccagaggatcaaggcttccatcccaagcatcaagtactgcctggacaatggagccaaggcagtagttcttatgagtcatctaggtcggcctgatggtgttcccatgcctgacaaatattccttagcacctgttgctgttgagctcaaatccttgctgggcaaggatgttctgttcctgaaggactgtgtaggcgcagaagtggagaaagcctgtgccaacccagctcctggttcagtcatcctgctggagaacctgcgctttcatgtggaggaagaagggaagggccaagatccctctggaaagaagattaaagctgagccagataaaatagaagccttccgagcatcactttccaagctaggggacgtctatgtcaatgatgcttttggcactgcacaccgcgctcatagttccatggtgggagtgaatctgccccataaagcatccggattcttgatgaagaaggaactagattactttgctaaagccttggaaaacccagtgagaccctttctggctatacttggtggagccaaagtggcagacaagatccaacttatcaaaaatatgctggacaaagtcaatgagatgattattggtggtggaatggcttataccttccttaaggtactcaacaacatggagattggtgcttccctgtttgatgaagagggagccaagatcgttaaagatatcatggccaaagcacaaaagaatggtgtaaggattacttttcctgttgattttgttactggggacaagtttgacgagaacgctcaggttggaaaagccactgtagcatctggcatatctcctggctggatgggtttggactgtggtcctgagagcaacaagaatcatgctcaagttgtggctcaagcaaggctaattgtttggaatgggccgttaggagtatttgaatgggatgcctttgctaagggaaccaaagccctcatggatgaaattgtgaaagccacttccaagggctgcatcactgttatagggggtggagacactgctacttgctgtgccaaatggaacactgaagataaagtcagccatgtcagcactggaggcggtgccagtctagagcttctggaaggtaaaatccttcctggagtagaggccctcagcaacatgtagttaatatagtgttacttccttctgttttctgtccatggcccttaagtcagcttaatgcttttacatctcgatgtgacttttgttaaaatctactcctagatcaagacctatgtaatggacaagcagcaggccatcaggaactcttaatatcagcacagcaattcattttagtttggtcacgcatttgcctgttcaagttctcatttgaacttcaccattgtgctatctagggaggacatattcttaagttgcctattaaagaaagtgagctgaagaaactgaatctttttattttagtccaactttgctattgtttcataatttgaaacccaaaagataaaacttaatttgttgggaaagggtggaatgaaagttgacaaacaaacaataaatatgcccaaataaactgagaaaaataattacatataaagaactcatgggtaccattaaagttctgctaaggggaaatgttatactaaataggaccaaaaaaaagagaaatgaaagacacttattaaacccaaggaatttttaaaaagaaaagaaattaaactcaag

SEQ ID NO: 465062 - DNA, 5910 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgaggtaggtaggggtgcgcgggctggtcagccggccgggagcggggtagggcggcggcgagaacgggcgcctcgctgaccggggagaagaggcctcctgccaaggggccctagtgtagccggagtgagaggaggggccccggacgtagcctgctcttccccggtgtggagccattacggggggacattcctcctgcggcggggggagggagccccctttcttttctttgagaggtcagaatccgcagtccgcccttcgcctttaaataaaagcctgccggctcgagatcggcgtcgcgatggagtgcccgtggacttctacgcttgcggaactccgagtggacggatagcggcttatgaattttgctttttagagggtacacaaccctttctctagggtggcgtgcatcttctgcaaacttgttattgccaatacgctaatagtcgctttcagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaaccagctatgtttactatgttttttagtgtggtacttttcaagtacttaagtggtaaatggtaaacctttttcatgactgtagatcttgtgtttttctt

SEQ ID NO: 465063 - DNA, 437 bp, Homo sapiens
  misc_feature (2)..(2): n is a, c, g, or t
antgtgtcaagtcgattgtgaaatagaaatgcctgaagaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465064 - DNA, 591 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctg

SEQ ID NO: 465065 - DNA, 5164 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465066 - DNA, 5110 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465067 - DNA, 3621 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgaggtaggtaggggtgcgcgggctggtcagccggccgggagcggggtagggcggcggcgagaacgggcgcctcgctgaccggggagaagaggcctcctgccaaggggccctagtgtagccggagtgagaggaggggccccggacgtagcctgctcttccccggtgtggagccattacggggggacattcctcctgcggcggggggagggagccccctttcttttctttgagaggtcagaatccgcagtccgcccttcgcctttaaataaaagcctgccggctcgagatcggcgtcgcgatggagtgcccgtggacttctacgcttgcggaactccgagtggacggatagcggcttatgaattttgctttttagagggtacacaaccctttctctagggtggcgtgcatcttctgcaaacttgttattgccaatacgctaatagtcgctttcagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465068 - DNA, 5512 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaaccaaaaaaaaaaaaaaaaaaaaaaaaaaaaaaaaaaaaaaagaaaaaaaaaaaaaaaaaaaaaaaaaaaaaaaaaaaaaaaaaaaaaggggggggggggcaaaaaaatccccccagagggaggccaacaatattagtaagacaaccacagcatggtagaaaaagaagaggggcgcccccaaaaagagggacgcgaaataaaacaaagaaagagaacacgagcgcagggaatgtaataaaacacgcgcggggaggcgaaaaaacaagctaccaacgaggagaccccacttagggaaaacagcacacactactctgggggggaggaaaaaagtggcggcgcaaccacaccgtg

SEQ ID NO: 465069 - DNA, 1955 bp, Homo sapiens
  misc_feature (25)..(25): n is a, c, g, or t
gagagagagagagagagagagaganagagagagagagagagagagagagagagagagagagagagagagggctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465070 - DNA, 1955 bp, Homo sapiens
  misc_feature (25)..(25): n is a, c, g, or t
gagagagagagagagagagagaganagagagagagagagagagagagagagagagagagagagagagagggctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465071 - DNA, 1110 bp, Homo sapiens
  misc_feature (796)..(796): n is a, c, g, or t
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaacccagctattttttctttcgttttttaattttaaagttggggggggtctcaatttgttaccctggctggtctcgaactcccggacttaagcgatcctctggctccaagcccactaccagtctcaggtttctttactaaaagatcactaccttttttctcttatctgctgccatgtgagatgtggctttcaccttccgccatgattgtgaggccttcccagccacgtggaactgtaagtccaataaacctcttttgtaaattaaaaaaaaaaatcactatttaagatactaggatggattgtgactgttgaggagtacttacatatcctacatttgactacattatttccaaaccaagtattccatccaaaggaacatactggtatcatagagaccaaggagggactgtttaaggttgccaaggtgaagcgagctgagaggntttgtcctcgtgccagtaactctgaaatctctcttaatctgctgtcaggcagcagaatgcatgtttccccaagtaagtagctgcttaacagtaaagccaatgtccgttctgtgatcccaggtctctgacttctgaggggtccgtctgcgactggttaacttaaatcccctgtaggggataaaggatccctttcagtggaccgaacggccaattggcaagatggtgctcgggttctcggccgaaaccccccgggttgcgagtctgaggacgggtaaaccggggggcgttggggacccaagggcaaaactcgctgg

SEQ ID NO: 465072 - DNA, 5096 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465073 - DNA, 3135 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465074 - DNA, 1991 bp, Homo sapiens
gttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgaggtaggtaggggtgcgcgggctggtcagccggccgggagcggggtagggcggcggcgagaacgggcgcctcgctgaccggggagaagaggcctcctgccaaggggccctagtgtagccggagtgagaggaggggccccggacgtagcctgctcttccccggtgtggagccattacggggggacattcctcctgcggcggggggagggagccccctttcttttctttgagaggtcagaatccgcagtccgcccttcgcctttaaataaaagcctgccggctcgagatcggcgtcgcgatggagtgcccgtggacttctacgcttgcggaactccgagtggacggatagcggcttatgaattttgctttttagagggtacacaaccctttctctagggtggcgtgcatcttctgcaaacttgttattgccaatacgctaatagtcgctttcagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggaaaaaagcagcaagccttcaggtgttccagtgatgcctgacacaattgagctggactttatgttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaacca

SEQ ID NO: 465075 - DNA, 1533 bp, Homo sapiens
aagaagcagtcttggacctttcatcttcagagaatgtcacgaggaacagagataagccacccctgctgagccctgcccaatctgcagattcgcactggggaaactctttttctccttactcctggagattctgatttcactgtgcgacctgatggggagttgccaggagaaggactgcgtcggcctttggaagctggtgaagccgcacttgcctggacctctcctggagactcagctgctaagtgattcatttcagatccatctcctttaactgggattggttttaccacctgaatcaaagtattccaatattttgattacttaaaaatataaaaggaataccctttgccatctcaatatggcttcaatgaagaatttcctaccaccattctacggcagttagctgctctcccgctgcatggtaaatattaactacaatatatcataaaattaagtatatgtttaagtatctgcttccctctccacattgtgagctcttccaggacaagttccctcttattcattgttctatcacactgcccagtgacctgacatactgcccctttctgggaagcgaagggtctgcccagtcctaagggtggtggctaatgcttaaggtgctttatacatctgaatccatcccagcttccacagctgcctggtccaggaatgttccttggtccaatgaccttctgtactgaacggtattgtacgcctgagtcagctctctccctgagagtttgaaagtaaaacacacaaatagtgttactgcaggaagagtggcacttaacacggaaacagagcaaggtaataagtagaaacactgagacagaaataagggagaagagagagaaattagaagaaagacagggatgcagaagcaacaaaagtcaacctaacaagttgtacacgggtcccctgataagctgttagatgatgacagccacttttataccacccctggataatgaatgactagttctccacgggccaagtgtacatgctgcaatggaggaaacttcttggtggattctttaatttggaatgaaataaattttaacccatctctgttccctgcaacctcaaatagtctgactaaaacactacatacagaagaagcaaaaaataaaaataaaaccctagtttatctagttttccttaggcatatttcctggtgtcagtactctgtagggttcacctcattaactgaagctctagggtccccttggagaaacgatcccaggtgctgccttcagcctcccccactggccacgtcccctaaaactcagtgtgaagaaatcttcctcagtcctcactcagcaaagagcactgctataatggcctcttatctgtttcccactcttgactttgagatccaacaaagcctttgtcttactcatctttcatccagactcccaaatgcccagtatttgtacataggaagctgtgaggaagcaatgcctttccaatatgaacttctacgccagaaagatctccaagatgtaaataagcttcactgaggcctttgtgtat

SEQ ID NO: 465076 - DNA, 622 bp, Homo sapiens
aagaagcagtcttggacctttcatcttcagagaatgtcacgaggaacagagataagccacccctgctgagccctgcccaatctgcagattcgcactggggaaactctttttctccttactcctggagattctgatttcactgtgcgacctgatggggagttgccaggagaaggactgcgtcggcctttggaagctggtgaagccgcacttgcctggacctctcctggagactcagctgctaagtgattcatttcagatccatctcctttaactgggattggttttaccacctgaatcaaagtattccaatattttgattacttaaaaatataaaaggaataccctttgccatctcaatatggcttcaatgaagaatttcctaccaccattctacggcagttagctgctctcccgctgcatgaaggtaacaatgttgactagcaacatctagaatatgaagactgctgtacaaggctgcttctgctggtattgagggagagaagaagctctagccagaagacaaaggaggcttcaactgtttaatattagttcctttaaaaaatacacatccaactgcactgcagcaagtacaataaaatattaacatttattaaatacaggt

SEQ ID NO: 465077 - DNA, 1912 bp, Homo sapiens
ccggcgtcggtcgagagcgcaggcccggcagagccgcaggcgctaggccgcccgacacagcccgcgcgtccccgcggccggtggcgcctcgagcggccacgtgcacgcgcgcactccgcctcaccagccttcttgcgccggagacgaacccgctgcctggctggagctctctgggcccttcggcctcgggagcaacgcgttcccggcgacttctgacacagccactgtttctgcagaacccagtagatttcctacggtaagaaagagaaagaaggaaacaaattcacttccaagtatgaatttctaaggacagtctgttaattattcatgtcagaactggctgtcagtctgattaatgttacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctgagatgggtctgactggcaatggctacagtagtaaagatgccgcagatgatataggggcacagagagactggattgtagaaaacaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtctgacggtaactgctgtaaaagactcaggagaatggaatttggaggctggggcattagttcttgcagatgcgggctttgctgtattgatgagttcaatagcctcaaagagcatgataggaccagtatccatgaagcaatggagcaacaaacataagtgttgctaaggctggcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctccttt

SEQ ID NO: 465078 - DNA, 1778 bp, Homo sapiens
ccggcgtcggtcgagagcgcaggcccggcagagccgcaggcgctaggccgcccgacacagcccgcgcgtccccgcggccggtggcgcctcgagcggccacgtgcacgcgcgcactccgcctcaccagccttcttgcgccggagacgaacccgctgcctggctggagctctctgggcccttcggcctcgggagcaacgcgttcccggcgacttctgacacagccattacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctgagatgggtctgactggcaatggctacagtagtaaagatgccgcagatgatataggggcacagagagactggattgtagaaaacaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtctgacggtaactgctgtaaaagactcaggagaatggaatttggaggctggggcattagttcttgcagatgcgggctttgctgtattgatgagttcaatagcctcaaagagcatgataggaccagtatccatgaagcaatggagcaacaaacataagtgttgctaaggctggcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctccttt

SEQ ID NO: 465079 - DNA, 1218 bp, Homo sapiens
tcctgtgactggaaaaacatcacctctcatccctgaatctcagttgctgagagcgcaaactaagggcaggggcgggggaggcctggagtagggtggtgatcagctgctaagatctctcccagaatgaatgctgggattctcctattctttgtttcccaaggccgttgaattcatccccatgcaagctaaccatggacttgtcattgttagaggtcagaggaagcagcctctggcggtgtggagccttcatgtgactgctgtgttaatggtaacccatgtggattttatattaaatttccttccacataaccaagttataccaactatcaccctgagtacagaacaggaatttggtggatctcagctgagtactactgtcctgaatctgactcacatgccaatcaaacaagaagccccttccaccccttataccataccaccaagacaggtgctggaagacagagccctgcagtggctgctttttcactcagtgtctcctcctagatctgtacactcagaaaacaccttcctcattgcctacctcttcctcaaaacaaacccatccacctgttctaatgggctctccaaggagaaggcagcaatccactcacacaggctgctaaagactgactgtgttaaggattctaatgggcaagtctctaaaacactacagaggtgatattagttgacagaagcttgttggaaaaggatttagaggctaacaagggctttcaaaatcacacagctttggatccaagaaagggcttaagggaagagttggttgtggaaaaaatatacagaggagccctgtggtgacacaaggcatggtggggtggatgggcagggatgggcattattgcaggtatcttgaaggagagttgagcccagcttttcaattcatacagatcctttctctgaagaaccccttcctgatattgtcactttaacacatctctgtggttttattttgaaatttttaaaggtacagtcatgtgccgcataatgacattcagtcaatgacagactgcatatatgaggtggtcctgtaaggtgataatggagctgaaaaattcctactactgaacgacatcatagccattgtaacatcatagcacaaccaatcaccttttctatatttaggtatgtttatttagaactgtattagtccattttcgtgatgctgataaagataaaaccaagactgggaagaaaaagagg

SEQ ID NO: 465080 - DNA, 1289 bp, Homo sapiens
agtgagatcatgcggtatgaaacagctcttttcaaagcctccagtgttctgttattcagcctgatgggtgatagtcattccttccatccttcgcctgtcattaggattccatgcagctgacggtatcttcctcctcggagcacctgtcttgcttggttcctgggacgccaccctctcctggctctcttcctactttgtggccgctccttgcctttccttgctagattttctttatctttctggcctccaaatactggcccatgaccagggctcagtgttggcccctctttttttgtggctctacccaccttacctgtatgatttcttttactttcaaagctttacgtatctggagacttgtgactttcatatgtacttttgcaacttggatctgtcttgtcctttctacatctatgtatgtccagctcctgcaggcatttcacagagaaatcagacaacttttgagattaaccccctcagcagttttagggatgaattggcaagacaggcttttgaggcaggatctttctggcactttacttcactctctttggcaaaaagaaggtctgtggctcgtgtgccggaagtagtctgcttcttggttgggagaagaaggggcttgggttcttggagcaagaatcagccttccaagtgtgagatgccagtgcagggccatgtcattgaaaagctgatgatgatcttctcaagttgttgctttaaccacagtaagacaaataagaccatccctggcccaaggaggataggtgaagggtgggtggacaggtatctacctgggaaattagccattgttaatgttacagcaaaatgccctattacagatgctaggaggtggggaaatgccaactttgcctcttccgggcagtgctgtggtgatgcagccttgggccccgccagcagcggcttgctggctggcgcggggtcctctcccgggtccgctgcgttgcgcgggcaggacagtcagaaagatcttcctgactgccatgtggagaatggattggaagggaccagactggagctaaggatgctcttggaggattttgtgtatggacaacacagccatggagaaaaaggctcgaagaacactggggccatggaaggagattaaatattaatttcatttcacagattttgaaattttaaaacatacattgtaattcagaaggaaggagggaagaacttgtccattaaatgttggtactcctgaaggttctgttttaggctctatcgtcctttgtgatgcctttttatgataaaactcagtcatccac

SEQ ID NO: 465081 - DNA, 1185 bp, Homo sapiens
  misc_feature (1)..(2): n is a, c, g, or t
  misc_feature (12)..(15): n is a, c, g, or t
nnccaacatccnnnnctgagaggatgagccatgccctggtgctgcgtttcccagccagagcccagccccctttcatccaggtgaaaaactctgtggagccatcagactcccaagcttatctgaaaccatatctttgctcatcttctttcccagccccagccacttccttcctcaataaatctctcatacaagtattactgactgaagctctccttctagtgaatctgttccaggcccagtgtgagagaataaaggcttacaaaaggattataaaaatacagagaagaggaaagagggaagaacagaactttgagaaacacatgatgtacttggtgagagaaggagtaggaaaagaaacagaaggagtttcaaagtcgctggagacagaggagaaagaagaagggaaagaagagaaaactggtatggatctatagacatttttagataaaagagaaaaaggttgagaagtttcatatcagagacaccttatcatctcagtgtagttactattgcagagtcagaggctgtgtaaacaagacaaagttggaaaagccaaggagtggattccttaggactcagagacagatagaaaggttatctggagaaaaagcaatggaattgaagagaaaaatgcaatgcacaggatgagtcagaaggggagggatcagacataaaactaactgcaaagttgtcactatagtttcaataagaaataatgggagcatgaactttgcagaaaagataaaaatggaatgaagacagaactctgtgagagaaagaacatagtaactattctaatgatgttgggatcctcagtcttccagaggatggcaatgggatttgctaatacaggatgggagagagaatgatgtgtgagtgtctgtgatgaagatgtcacacttacagcagaaactgagaaacagtggataacttctgaaatctttgggtataatcatctatcttgtgtgatctaataatttaagaaagaagtgattatgctgttgaaatcgtgaagattttacaggtaacacttcctttccttcctttgttttgataacagatggagatatttacaattttaataaaatctagaatggggaggcaggcaagtcaatgccaatcttcccattctatttggtgataacttttttgtagtgtgaagagtgtgtggtatttttactagta

SEQ ID NO: 465082 - DNA, 846 bp, Homo sapiens
ggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgcaagaaacgagtcgtgggcaagaaa

SEQ ID NO: 465083 - DNA, 1312 bp, Homo sapiens
ggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaaaaaaaaaaaagaatttttcaatccatttacaacttggggaagttttattgtgatggtgtcacaattttatttttatttcaaagtgctttgccaatagtcacaatggcatgtaatattaataaattactataacttttcaactttgaatataactttgaagtagaatcaaaatatcatagtagcgagagggacagaagcttatgaaaagaatcttaaacttaa

SEQ ID NO: 465084 - DNA, 1329 bp, Homo sapiens
ctcctgacctcaggtgatctgcccacctcggcctcccaaagtgctgagattacaggcatgtgccaccgcgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgactggggctgaattgctctgccaggagcatttggtatgagatgaaatggcctctcttgagactgagctgccaacctggcaattattgtctgctaagggttctctttattcacccttacttggacttccttttcctgtagggaatctcacgtaaaactgaaattcttccctcccccagggttgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaaaaaaaaaaaagaatttttcaatccatttacaacttggggaagttttattgtgatggtgtcacaattttatttttatttcaaagtgctttgccaatagtcacaatggcatgtaatattaataaattactataacttttcaactttgaatataactttgaagtagaatcaaaatatcatagtagcgagagggacagaagcttatgaaaagaatcttaaacttaa

SEQ ID NO: 465085 - DNA, 777 bp, Homo sapiens
gctgcgtagtattccatggtgtatatgtgccacattttcttaatccagtctatcattgatggacatttggagaaaacaaccaccagagggccttatgcctggagaaatggcagagaaaaccttactggccttaccttcagtgtgcccccaccccatgggaaagaggaggttaggattgcatcatacctggtggaagtttttgtatctttaagaattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaaaaaaaaaaaagaatttttcaatccatttacaacttggggaagttttattgtgatggtgtcacaattttatttttatttcaaagtgctttgccaatagtcacaatggcatgtaatattaataaattactataacttttcaactttgaatataactttgaagtagaatcaaaatatcatagtagcgagagggacagaagcttatgaaaagaatcttaaacttaa

SEQ ID NO: 465086 - DNA, 537 bp, Homo sapiens
tggggactttggggtgcccatcgccatcctcatcatggtgcttgcgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaaaaaaaaaaaagaatttttcaatccatttacaacttggggaagttttattgtgatggtgtcacaattttatttttatttcaaagtgctttgccaatagtcacaatggcatgtaatattaataaattactataacttttcaactttgaatataactttgaagtagaatcaaaatatcatagtagcgagagggacagaagcttatgaaaagaatcttaaacttaa

SEQ ID NO: 465087 - DNA, 1697 bp, Homo sapiens
ccggagtccgagccgcgggctgacttccgctcgggaaagtggctccaagagcccgccacaggggacgccagggactcgcggcaggctctgcgggccaggatgagttctaagcacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcgaaaaatacagagtcccaatttgagaaggtgccagaaattatgggagttatctgtgcccagttatccataatcagccagcctagagtccgccaacaaatcataaataccatgtttctcacactgaaattcatgaaccattggcttaaaggctgtgcgctttctaaattcagatgcattttcagcacacttaaaatgtgtggcaaactaaaagcattttgcaacacttctctcacaataaacagcttctcaaagtacttcatttactccctcaggaatccaaagaaaataaccgaggtgataagcggaaaagaggtatgaggaaggggctttattgacccaaccagaaacagaaactaagaacccatgactgtcatctgtcccttggaaacatccctggtttaatatgtttaaaacattccttccctcatcctctaaaaaatatgtatcatcatagttaaagagaaatgcaaacttgtgggaaaaaaacctcaaatatcgt

SEQ ID NO: 465088 - DNA, 1879 bp, Homo sapiens
gtctttctgctgcccggcccattttaaaggaacaggaagggtctcgtcgggaggggatagcttagaagggatttttttttcctctttagaaaattgtggcagtttctggccgggcgcagtggctcacgcctgtaatcccagaactttgggaggccgaggcgggcggattacctgaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcgaaaaatacagagtcccaatttgagaaggtgccagaaattatgggagttatctgtgcccagttatccataatcagccagcctagagtccgccaacaaatcataaataccatgtttctcacactgaaattcatgaaccattggcttaaaggctgtgcgctttctaaattcagatgcattttcagcacacttaaaatgtgtggcaaactaaaagcattttgcaacacttctctcacaataaacagcttctcaaagtacttcatttactccctcaggaatccaaagaaaataaccgaggtgataagcggaaaagaggtatgaggaaggggctttattgacccaaccagaaacagaaactaagaacccatgactgtcatctgtcccttggaaacatccctggtttaatatgtttaaaacattccttccctcatcctctaaaaaatatgtatcatcatagttaaagagaaatgcaaacttgtgggaaaaaaacctcaaatatcgt

SEQ ID NO: 465089 - DNA, 1726 bp, Homo sapiens
gtctttctgctgcccggcccattttaaaggaacaggaagggtctcgtcgggaggggatagcttagaagggatttttttttcctctttagaaaattgtggcagtttctggccgggcgcagtggctcacgcctgtaatcccagaactttgggaggccgaggcgggcggattacctgaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtgccagaaattatgggagttatctgtgcccagttatccataatcagccagcctagagtccgccaacaaatcataaataccatgtttctcacactgaaattcatgaaccattggcttaaaggctgtgcgctttctaaattcagatgcattttcagcacacttaaaatgtgtggcaaactaaaagcattttgcaacacttctctcacaataaacagcttctcaaagtacttcatttactccctcaggaatccaaagaaaataaccgaggtgataagcggaaaagaggtatgaggaaggggctttattgacccaaccagaaacagaaactaagaacccatgactgtcatctgtcccttggaaacatccctggtttaatatgtttaaaacattccttccctcatcctctaaaaaatatgtatcatcatagttaaagagaaatgcaaacttgtgggaaaaaaacctcaaatatcgt

SEQ ID NO: 465090 - DNA, 1256 bp, Homo sapiens
agcggagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccacgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccattttttggtgtgtttatggaagtgcat

SEQ ID NO: 465091 - DNA, 1869 bp, Homo sapiens
gagtttgttgctcccaccgagttctgaagaacgccagcagctcgctgcttaaaattaaaccacagggttccatgatgggtcaacttgatgggaaagtcatcatcctgacagccgctgctcaggggattggccaagcagctgccttagcttttgtaagagaaggtgccaaagtcatagccacagacattaatgtgtccaaacttcaggaactggaaaagtacctgggtattcaaactcgtgtccttgatgtcacaaagaagaaacaaattgatcagttcgccaatgaagttgagagacttgatgttctctttaatgttgctggttttgtccatcatggaactgtcctggattgtgaggagaaagactgggacttctcgatgaatctcaatgtgcgcagcacgtacctgatgatcaaggcattccttcctaaaatgcttgctcaaaaatctggcaatattatcaccatgttttctgtggtttccagcatcaaaggagttgtgaacagatgtgtgtacagcacaaccaaggcagccgtgattggcctcacaaaatctgtggctgcagatttcatccagcagggcatcaggtgcaactgtgtgtgcccaggaacggttgatacgccatctctacaagaaagaatacaagccagaggaaatcctgaagaggcacggaatgatttcctgaagagacaaaagatgggacgatttgcaactgcagaagaaatagccatgctctgcgtgtatgtggcttctgatgaatctgcttatgtaactgattctgcaccctgccccacaacttgtaaacgtcccaaaaggaaaaattgatagggaatgtaggcctcactttaatgcattctccctctcttgggatcttgacctgtcaagtcctgactgccttgatttccctttgctgcctttaaaaatgtctgttttctagatgttcttagcaggagagttagtctgatactagctactcaatcttaatcaaaagcatgagtggtaattactttttaataggctacaagcaatacaaagttaagaactaattggatttattaaattatttggttaattaaactaataactaccttgaatttccacagcactgctcttccaatgatttcaaagtattttagcacattaacaaaggaccattactagtttcctccagctctaacttataaattttaaattgatgtaacagaagaaaataacttaagttcataggcatgaggtatccagaaaaattagataaaaagaggtactaaatatgctgattgccaaaatcatcagaatgatttgaaatcccaagaaatagactccccctaagtacactatgattcatattaagcttgtagttgcccatatcctctggtgttctagagggatatggaaagtatgtagcatgtgcttagtgctggtttggttacatcatcaaacagagtaagcagattggtatcaaggcttctcagaaagtttttagaaacataattatagtaaaataattgtctgtaagacttatgagacaacaaatactgtcattaaacattggtttcttatgtaagtggaatcgtaacagtattacaaaccatattctgtttatccttttaggtttactgtagcagtagcctttgaagtcacatgttattctatggagatttttctatgccttctctccagaattggcatgaaacatggattctttacaaatttcttacaaattcattccagagaggcatgttcagcttataaaagaaatttaaagatttttctctaaactgaatggggagaaaacttactaaatatgcaaggaggagcctgtagattttaactctaaatcacagcaaatagttacaaatgaaacacagag

SEQ ID NO: 465092 - DNA, 1614 bp, Homo sapiens
  misc_feature (5)..(5): n is a, c, g, or t
ttccngcatttccaattaagtcctcaattaagttgtgccctatactgatattatttcccctagatcccagaaactgactcctattgaaggaaaaaatctgatatcaatctttttaaaaggggaggaatgtgggagaaagcatgaaaatggctactgggaaaacttatttgtgttacctttctgaaggaaaatacattttttattccttcaattgttgaacctttcctccaccctcaggagttgtgaacagatgtgtgtacagcacaaccaaggcagccgtgattggcctcacaaaatctgtggctgcagatttcatccagcagggcatcaggtgcaactgtgtgtgcccaggaacggttgatacgccatctctacaagaaagaatacaagccagaggaaatcctgaagaggcacggaatgatttcctgaagagacaaaagatgggacgatttgcaactgcagaagaaatagccatgctctgcgtgtatgtggcttctgatgaatctgcttatgtaactgattctgcaccctgccccacaacttgtaaacgtcccaaaaggaaaaattgatagggaatgtaggcctcactttaatgcattctccctctcttgggatcttgacctgtcaagtcctgactgccttgatttccctttgctgcctttaaaaatgtctgttttctagatgttcttagcaggagagttagtctgatactagctactcaatcttaatcaaaagcatgagtggtaattactttttaataggctacaagcaatacaaagttaagaactaattggatttattaaattatttggttaattaaactaataactaccttgaatttccacagcactgctcttccaatgatttcaaagtattttagcacattaacaaaggaccattactagtttcctccagctctaacttataaattttaaattgatgtaacagaagaaaataacttaagttcataggcatgaggtatccagaaaaattagataaaaagaggtactaaatatgctgattgccaaaatcatcagaatgatttgaaatcccaagaaatagactccccctaagtacactatgattcatattaagcttgtagttgcccatatcctctggtgttctagagggatatggaaagtatgtagcatgtgcttagtgctggtttggttacatcatcaaacagagtaagcagattggtatcaaggcttctcagaaagtttttagaaacataattatagtaaaataattgtctgtaagacttatgagacaacaaatactgtcattaaacattggtttcttatgtaagtggaatcgtaacagtattacaaaccatattctgtttatccttttaggtttactgtagcagtagcctttgaagtcacatgttattctatggagatttttctatgccttctctccagaattggcatgaaacatggattctttacaaatttcttacaaattcattccagagaggcatgttcagcttataaaagaaatttaaagatttttctctaaactgaatggggagaaaacttactaaatatgcaaggaggagcctgtagattttaactctaaatcacagcaaatagttacaaatgaaacacagag

SEQ ID NO: 465093 - DNA, 1334 bp, Homo sapiens
tattgtcgtagtctcctctggagaaaataatctgtgaaattatgtgaatagagaccatttttcaaaacaatgggggaaagagcaggaagtccaggtactgatcaagaaagaaaggcaggcaaacaccattattcttactcatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaagagtgattttgcagacctgtgtacaaaaggagtacaaaccatggaagacttcaagccagaagaatatcctttaactccagaaacaattatgtgttacgaaaacaaatgggaagaaccaggacatcttactttgaatgggaaagagaagaacttgataaaaagcaaaaagaaaaggcatctttactggaaagagaagaaaagccagagtgggaaactggaaggaactttccataaggatggtaacaacagttcacaaggggcaaaagcaactaggaccgaagtggctctgccagccagtccagcattggtgtagacagctacttgtgatacttatgacgagggctggcctgcattctttttgtaatttttaatctgtattattataagttacaattaagtagcattttc

SEQ ID NO: 465094 - DNA, 979 bp, Homo sapiens
  misc_feature (390)..(390): n is a, c, g, or t
cttccccaagcccaaatctagacctcactgaaactggaaaagaaatgagatctatcatttgccaagggagatataagaaagtagtcacatgtatggactttttgcatcagcaacttcctatctcaatggagaccgcctatcgaatgggaattttctaccccaagacacctgagacagaccacagtacacgctgccagattttcttcattcgtgttcaccaaaacaagatgtggcaccagattgaatgcagaagcagatatgaagattcagctgtcttcgatgagtgctacctgctacggtgcttggtggatgctgctgttgtggcggttcttggtcgttgttattactattatgctcaatgctcacccaccatggcagccctcaggaccntggagcaggggcagttgatggctatttttaccctcacaggggataagcctccctgaggctacagaagcaaagcccagagatgggagtcggggagacagagcctcctcatgatgtcacgatgtcacctgagctcctgggtccagcttgtttcatgagctgagactaatgattgtaactgttcgggcacggtgaggcaagaggaacgtacagttacagaatccgtgggcaaagcatctcggggccaggagcgagcctgaaggcactgtgtaggccttgatcagtttagcaatttctacgattctgacatcctctttctgttctttccggactcaggcatccaaggtcacctcattatggctctgtgcgaagacagcaccccaaaggggccatcgatttggaacatctgatcggctttctgagtcagatccactagctcgtaaaatccaataaatgtcaaagatatgtcaggcccattaacctctggaggtctattaaaagactctgcttctgctaaggagattctgttactgtcacatggacaccagggcagccaattctaaacccctgaatttagaaagttaggaagggg

SEQ ID NO: 465095 - DNA, 1511 bp, Homo sapiens
agaattccacttgctctctagttctgctacttacattttccatagagggtcctgagctgctcatttccgggacttgctgagccctgacagtaaacagacttttaacaaagactcgctaaataacttcccggaatggaatcacggctcaaagaatcccacaaggaaagacaagcaagtgagcgtgaaaagccagatgtgaaaggcagcagaaatgcttcacgtgaagaagtttttggcaaagtggcagaggtggtgaaggacatcatgaaaaacctggagccaatgaagcagaaagacttattctggaatacatggtgtggcatcctagaaaactctagatatgacaggcatgcagcccgtgtggtcacacagggtcctgcactcagaagatccctgcacatgactcagtgctctactgttgccatcctgaaattgttaatagtgtttgaacaagaggccttgggatccatgtcctacactgctacaagaatcactgattacattggcaattcaacatttattaggtcaaatggaatccatcgtagccaggacctcagctctccttcagtatgctcagataacacctgaccgaatatgggaagaggctcattgtgtaaacacaaacgtggaagtgccttttattaaaacaagattttacctgtagaaagatttgagcattcaatttgcctcgaggtagcatctttacctggaaatgaaatctcattctgttattggagccaatgtgtttatgtcaccattggatgcaggaacaacttaaaaaataatagtatacatatgttatgattaactctaaacttttgtttactttaaggataagctaaaaaaactcactattgtcaaaaatagcttctgtaatttgttcttttcacaagaagtaaaattcttgtgttattttttattctctgtaccttgcgaataactcataacttaggagttcccaagttatgttcattcctccattgcaatctctgtcccacccttccctttctttccatttccgttgcaatgtaatgtaaggttaagagcatggaatgcaagaggtgccagtttcaactctagctctactgtttctagctctgtgtcctcgagcacattatgtcccgtactcttgcctcagttataccatctgtgtgtaataatgataatactacctcctttatagggttggttaactaatggtctgttttataaaggtctaaaaacattgtatacgttgaagggcttttaaaaatgctgtacttttagccaggtaaaaattcggttaagaattcaaactagcaaaagatgattctactttggcccaaaggcagtggtttcctgggtttgtgtcatcttgctttgcagcgtgtagacaattcttcaggagttgcagagagaaaaataacatgccagattttggggtcacagtgccatctgctgaagaaaggagtgttgctcgaacaatgagtccacatgatcacaatttgcgtaagtactaggcctagccaaaa

SEQ ID NO: 465096 - DNA, 1988 bp, Homo sapiens
gaagagcagctgccggtttcctggtgggccgcgctggaacctcggggcgagctgccaccttcagccttgggagccgaagctctgggcttcctccccggccgggcgacacccgggggacaccggggctctctcgggccgttaccctgcctatgtggactggtgtgcaccctcgggggaggttcctagggtgccacggtgcccgagcgcgacgagtgactgctggggaggggggccgggtcccggagcgcctcctccgggtggtctcccccccagcggggaccgcgcgcagcacctcgcgggcgccccagcccccgcaccctgcggagcagagccgagcgcccaggacgccgcgggccccagcggtcctccccaccccctggccgcgccgccgccctgcccggggcggagtaaacaagagacgcgcaagatttgacctggcgcgacccggctttctggccggggttccccctgagcagtctctggaattccgggccaaagacaataactgtggttctgcttttaaagcaggtatttcaccagcaactgcggaatgttttgtgtctccagtttcaaatttcgcggaaagggaccaaatgtgaggacatataaaatatccccttctcttttcattaaaaatgaaaaagcttcataaaaggcaaattttgggcctttatcactcagccccatggaatctgaatctttgtgggcccaggactctgcatttttaacatgtaaagcaattgttacttatgtattctaaagcacaagacctcctgccacagagcatgggacctgatatatccaggcaggagaactgggtaccaggagacactgtacatgaagtttccagaaccagccatgtccatcttactaatcaagactctctctgttaaatctgcaactcaaatgactttaaggaaaaatggatttcattgattcacataaccatcactcaaggactaactttcaacatagtgagatcctgaggctcaaatattattacccgaaacaaccttcagtacataagtaatggctgctggatgtaacttgcaattgggtggcaggtcggcaaggaaagaattccaaacagaggactttctgaaagcctaattatacatattgaatgtaacaaaaggaaaatagtttttaagggttccatgaactgcttcctctgacatgagatctaacaaggctaaagactaaaatgcagctgtttacagcgtaagtaggaggccgtcccgtgcagtgcaaaatcaacagagaggagacagtcctatgccttcgagagacagtctgctgatactgtcatgatgtctagtgacaggccagagatcaaaacccaacaccctcatttacctgacagtgatttggccaatcccttaacatctctaagagcttcatttttctacaaaattgagacaatagtatttgtttcatagtgttactgtcagggttaaatgttatacattaagcatttaatatatgctgcttgtttatctaaatattcatggtcaggcactaacttcttatgtgactctgagcaatgcattcatctctgtacctgtttcctcatccataaattgggagttgaacaaggtgagccctaagtttcgttccaacttcaatattctataattcttgcaacttatatggcctcagttttcttatctttataatgggcataagagtacctacctcacagaatttttgagaggataaaatgaattaagacaggtagaaaattcttagaacagtgcctgccacattggaagtgcttaatatgtattagctgtgatgatgctgctaatgatgaagatgataatgaccctatttgcagatagtatggcagccataaaacattcagtatcagattgattacattctcttattttctgagtcaatgccagagctaccaagattttattctttaaaggttcttcaagactaaattctttttacatgatatgattattacacattgtatgtcc

SEQ ID NO: 465097 - DNA, 959 bp, Homo sapiens
cggccgctcctcgccaaggctgagcgtgtctggtggggggtgtctggtagcatttccttaaggacagagggagggcgggcgcggagggagggaaaagatcccgaccgccagcccaggctcctcttgcctttatttatttttctgacaatgagatctaacaaggctaaagactaaaatgcagctgtttacagcgtaagtaggaggccgtcccgtgcagtgcaaaatcaacagagaggagacagtcctatgccttcgagagacagtctgctgatactgtcatgatgtctagtgacaggccagagatcaaaacccaacaccctcatttacctgacagtgatttggccaatcccttaacatctctaagagcttcatttttctacaaaattgagacaatagtatttgtttcatagtgttactgtcagggttaaatgttatacattaagcatttaatatatgctgcttgtttatctaaatattcatggtcaggcactaacttcttatgtgactctgagcaatgcattcatctctgtacctgtttcctcatccataaattgggagttgaacaaggtgagccctaagtttcgttccaacttcaatattctataattcttgcaacttatatggcctcagttttcttatctttataatgggcataagagtacctacctcacagaatttttgagaggataaaatgaattaagacaggtagaaaattcttagaacagtgcctgccacattggaagtgcttaatatgtattagctgtgatgatgctgctaatgatgaagatgataatgaccctatttgcagatagtatggcagccataaaacattcagtatcagattgattacattctcttattttctgagtcaatgccagagctaccaagattttattctttaaaggttcttcaagactaaattctttttacatgatatgattattacacattgtatgtcc

SEQ ID NO: 465098 - DNA, 1267 bp, Homo sapiens
gaagagcagctgccggtttcctggtgggccgcgctggaacctcggggcgagctgccaccttcagccttgggagccgaagctctgggcttcctccccggccgggcgacacccgggggacaccggggctctctcgggccgttaccctgcctatgtggactggtgtgcaccctcgggggaggttcctagggtgccacggtgcccgagcgcgacgagtgactgctggggaggggggccgggtcccggagcgcctcctccgggtggtctcccccccagcggggaccgcgcgcagcacctcgcgggcgccccagcccccgcaccctgcggagcagagccgagcgcccaggacgccgcgggccccagcggtcctccccaccccctggccgcgccgccgccctgcccggggcggagtaaacaagagacgcgcaagatttgacctggcgcgacccggctttctggccggggttccccctgagcagtctctggaattccgggccaaagacaataactgtggttctgcttttaaagcaggtatttcaccagcaactgcggaatgttttgtgtctccagtttcaaatttcgcggaaagggaccaaatgtgaggacatataaaatatccccttctcttttcattaaaaatgaaaaagcttcataaaaggcaaattttgggcctttatcactcagccccatggaatctgaatctttgtgggcccaggactctgcatttttaacatgtaaagcaattgttacttatgtattctaaagcacaagacctcctgccacagagcatgggacctgatatatccaggcaggagaactgggtaccaggagacactgtacatgaagtttccagaaccagccatgtccatcttactaatcaagactctctctgttaaatctgcaactcaaatgactttaaggaaaaatggatttcattgattcacataaccatcactcaaggactaactttcaacatagtgagatcctgaggctcaaatattattacccggtaaggccttctccatctctgttcttatctctctgcttcactttgcccttcaggcaaacattctgcaggttggtggcagcattcccagattatcttcttcctagataagcaacacagcaggaaaagaccttctttccagatagctcaggcagccttagtcatgtcattgcacctgaaccacttgcaggtcttgggtggagtgatctgatttggtcatgactagacctgaagaggagaaggtcctcatggggaaaaaaaaaa

SEQ ID NO: 465099 - DNA, 3844 bp, Homo sapiens
cctgacccctgccagagactggcactgcctgcgagggcagggcgggacaccctgagtgctcagtgggcttcttggccctcagtccccagaagcccccccggagccgtgccgggagcataaagccaccagggccgctgcgttgccactgccttgcacccccgggagctggggaacagacccgcacagccgtgaccacctgaaagccagatgagccaggggaagcagctgcgcctgcagccacccccactccagcatatggagaacgcggcaggacaagctggtgtctccgtggggtgcccccgttgtccccacgtctcacatacactcgcctgatgggtggccttccccacatccgggaccctggctagagtctgaaaggcggctgcccacgtcccagctgcccctgagcagggaggccggcaggggatgcacggcgagttctctcagtggtcggccgggccccagccccctgggtgctgcgaggggaccctgtgagcctgctgatggccagtgagccgcggtcctctggtcctagccggcctcgggtctgtggtcctccgggcaggacgtgtctggcaggccagaggcggctcctgtgtgcgcggaacagccgcttttacaggggcgtcggctcgtggcgctggcagggcttctgtcgcaccagccctcggcccgcggcaaatgccgaatgccggtgctgggaacggaagtgggaaatgacggggggtgcaggggagcggccctgactgggactgtacggggacgcatgggggtgcgggcacttgagggaggaagcagcagagggagaccttccggctgaacaaacgagaacatctcacagccctgcaacagccaggagctgctcgtggagctccacgcccggctggagagagaggaggcaccctgggcagcccgccagcacccaggctctcacagtggaagcccacgtcttcttgggctctattttgaaagctgttctttccacgacggctttgacaagaatcgatttgagtgagccggcgtgtcaatacaggccagcacaggactggcctcagggccacattggggagggtggcgaccaggccctggctgcagcccacgtgggcaaaagcatggccaggcaggaggtggggcctgtgagcttggctacagcgaccgtgggcgctgggcccggggctcctcagccctgaggggagacccaggcccaggcaggctcccaggcgggctcccgggctcccagccttccgatcttctccctttgagaccttgccttctgcacagtgacaggaaagagccctgagtcccactttgcagggatgtattgcatttccagaaagttccttccgggtgcagagtgatacatgaaccctggggactcactccaacttggtattgattttctccacggaggacccagcagtcacggcccgtgtctgcacagccccttggatcctgcggaggaattcagccggcccctccccctgtgccgaaaaccacggaggcaaagccaggccagggtacagtgagaacacgggagaggactgagagaccgctggctgccgagggaggaagagcaggattcgcacccccgtcatcgctgggcccacacgccgccgacagcttccgcgtgtggccatctgtctttcagaaaccctctggcagagggacccagcagatgacacgggggccgttcacactctgaaacctgcctggagtcaaaacactgctggcgagcctccaccgcaaacccaatccagatggtcttccctggtggccctcggggtggcgggcaccctgcccactccctgccagcccctgcccgctggactccaggcccggccgagcccccgaccggtctcctgacccagcatgctgctctcccctgggcccggctttctcgcccgctgggactcccaggcccctccagcccagccccgagagcaggagccccaagggaggcttggcggctgtggaggcgagtgggccacgtgtagctgggaggccggcaggaccaggagcccctcacagcgcagcacccacagcatcacgagccacttccactcctgggtggcctgggggcccccaccctgctctgagctgccccttgttgtgacctggggtcccccgtggtgggcccgccccttgagcctgggatccagcctcagcgaggctccagaagtgtcgtctccgccggccaggcgtcagcgcctccacccaggatcacacactcctatctctgcacttctgccctccatcctgctccacgccgcctctgcttgttattccagcacattccagggtgatgcctgctgaagccacgcagccagtgcctccaccctaccccccatctgacccaccggccccttccgcacgctggaagcctgcccggcctgaagtgtcctcacctgtcgccctatcctcccctccactccagcccaccggtgactcagccctcacagctctctcctccccgagggagccggagcctcccctgccaccgtgccagaatgtgccggaggaacagaggcccgagcctcccgtggccccagcgaggcttcctctggggaagacagcttgagtaaccaggacacagacctgggccatttaatgcgcaggcagccccaagtcccggcagggccagaagcagagacggcggctggggatgaaagtgcacgctggtcccagatggggctggggagttgagctgacaggaagtctgtaactttcctgcaaaacgttattctacccccgccagggccagtgtctgctgctgagcgcaggtcccaccagagccagcacgaaagccatagaaagacaacctgaagtcaccagtgtccctcggcagaaggaacaacccgtggtgtctcccgctccctccctgcacagccatgaaaagaaagggcctgtgtactctaacagcagggagaacacagtccccaagacccccacaggctgggaagtcagagatcacaggagaggtcacctctgggggtcatgactcgggggagtccctgggggggaccaggggttctctgtggttctggcgtgctcttggagggactcactgacacgcacggcggttacacgggcgcagacacgcaaagacctgagcacgagataagatttgtgtctttcgtgaaggaggaccttggatgtggagctggcaagctggagccgcccagggctgtccgtctccctgtggcttcttctccaggaggctcccgggagcaaagccgagtcggcaaggccatccgcccgctgagcagcggccccctcctgcaggctccggaggactcccctgcctgcatctggtctcgcatttcctccgtgacctccaagctcccactgggggcacacggctgccccgctgaccccaactctgaccctgtgccgggcaaggggaggggccacccccaccccgtcacgcgcatggaggaggaggaggagcccacactgccccagcgtccaccccacgcctacaccagccccacatgagctcgggggtctctgggggtcagtgtctgcagctacagatgtgagcacgcatgcgggtgtgcaggacctttgaccgcagcctcccatgcacccctggaaaggtgccttgcctctctccctcactcgccatgtgcagggcagtgggcgagtcccagccagcatgggcatcccgcatttctctgcttctgcagccctgactgaccatggccccccaagtgggctccagccctccaggcacctccccgtgccgtggtgcccaccacagggcctggtctcagggctcctccaggactggccaagtccccaggctcctcccccacccatggggggagaggtgcacagcactgac

SEQ ID NO: 465100 - DNA, 1351 bp, Homo sapiens
cctcccgccgccgccccgcccgctcctcccggccgttccggcctccgcttttggggaaagggaaggcccccaccgcgaagagagtctggcaacgccggaccgggacccccgagggacctcttcctccccgccgcccacctcagaattccttcctccccggcccctagtgggagcttaggccgggagtgacccctgagagggaggaggagcggtgactcctggaacagcccgcgggcggagagggctgcgcgagggcagtggcagagccattgaaaacacaccactctattcagaacccctccagaaacactgagtacgcgtggatacaaaggagaaaaccgaagacacctgggcctacttgagagcggagggtgggaggagcgtgaggatcgaaaaactacctatggcttactacgcttattacctgggtgacaaaataatctttacaccaaacccccatgacatacaattaatttatccatgcacatgtaccctctgaaccaaaaataaaagttggaaagtaaaggaaaaaaaaaatcaccctccagtgcttcccatctcactctgaataaaatttatttgatctcacccagtcatctcagacccagcacttacaaccacctaacacgggtccccaaaccccaggcaacagactggtacaggtctgtggcctgccaggaaccaggctgcccagcaggaggtgagcagcaagtgaggaagcattaaggtctgagctccacctcctgccagatcacggcggcattagatgttcgtaggagcatgaatgctattgtgaactaggctgtgggctccttatgagaatctaatgcctgtaatgcctgatgatctgaggtggaacagtttcatcccaaaaccattccccctgctcccacaaaaccagtccctggtgccaaaaagaagaacagaggagcctaggccttgccgatggattggatatggaggttctgggaaaggagaagtcaagaatcatcttcaggtttctgatttgatcagtgaggaaatagtggtgccatttacccagagagatagagaaagagccctggagcacaataaatcactcttctgtctgcctgcaagtctggcagcacctgccctctatcacaaaaagctattatcatattcattcattcatttgttgacccagtcaacaaatattttggagcacctactatgtgctgtgcattgtactgagccaggagatacagtggtgaacagccttcatgaaatatagttatatagaataatcgtggatcatatattctttttaaaatttcttttgctacctagcgtatatatttgtatacatgtagatatgtagctatttcaatat

SEQ ID NO: 465101 - DNA, 1096 bp, Homo sapiens
tggaaaacaatgtgtataatgattataaacattgactagatctcatgagacttatttgccatcacaagaacagcatgggaaacaccctcatgattcaattccctcccacagagtccctcctacaacacatggggattatggaagttacaattcatgatgagatttggatgcctggttattttggtttgggaactcatgttttctctgtgcccatgggctactctatctatctcataatactatctggaaaggatgcccatgtgaaatttggcctggcttccagacctgccttgcctgtgcccacgtggaattcagtaggatggaaagcacctgcagctctgcccactcaccccttgctggggaaagtgcaaagagctgctgtgtcttgcatggtgggagttagaagcaatgaacgtgaagaactagtggtaaaagaaaacagcaatgacaaacaacaaccaaaaaacagatattgctggtttgctgctgattcattctaatgaggcactcaataatattatttctcttttatgcatttctctttcacttgttaatcttacgataagcgtctaaaatgaacatgactctctttagtgtggattgagaatcagacagatttgggatacatatttgggtagaagacctttcttttttctgttcctatgaaggtgacctggggtgggccaagagagattcttgcaggcgatttagtgggtggaagtaaagcaacaactattttatatcttgcacatatttttgtcagtctggttaaattattgatgtgaggcatgaggtggacctacaactagtgcaccttccctttgatatttcttcagcttttctgactctgcggccaggtgtttgtatttaactccacggtgaggagactcatcttctgacggacctaacctataccatcaagctccagcaccacaagcaaagacaaaaaccttgcggaaactatttaactaactcccacaattgcataaggatctaaatgaaaatatttctgcagtgaaccagttctattgttttaaatatcacccttattaaagagagctttgacacttttctatgtaaagacatgattcacact

SEQ ID NO: 465102 - DNA, 1212 bp, Homo sapiens
gagcctgtgtcctttcatctttcctttgctcagatattagtaggtttgtgtcattgtttattggatgggacagttcagaaaagctcagagtgcgcctgcgctcaagttctcatttacctgttatgggtctgagtcagagccctggggcctgcatattgaacaagtaccccaaggggattctcgtgactgggcaaattcaggaagttctgtgcagttgggaatctggaagtggaactggataaaatacagtgcagtgatggaactagacttcaagaaggagattactgccaaacgtgctaattgcagtgattttctggaatctaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgacccttatgaggaagtgttgtgctttgcttttttaaaactttatattttgaaaacttt

SEQ ID NO: 465103 - DNA, 871 bp, Homo sapiens
caatacaattttcatcattttctttttcttgtaccttacatgcaagagaagccttttactggcagactgttgagggagatatggcagtttttagataaggaaataggtgacttgcggccaggcacggaggctcacgcatgtaatccctgcactttgggaggccgaagcgggcggatcacgatgtcaacagatcaagaccatcctggccaacatgaacatgcttctagaactttcatctattatgaaaaaataatgcatcaggagcagctggtacctgcaggaggagagttgtgcctttgtcagctcaaactgcaggaagcgctttgggacccacaccctctacagacacccaccaggcgaagggccctgttcagggtgctcccagcctgggctcacttccacaggagacccttcccttatgggggctggggacaggttctcaccctgcctgggcacactgcttgagggaggtctgatgctcgggcagggaggagctgtacaccgtcagaggagatctagggacaagagcggctctgcctcgaggaggaggattggtatatgtcacctcttccccagtcccagcacagcctagtgggatattttgcaagacagtaccccagctctgcagtggcagcaacagtagcagttggccccttaaacatgggtccagagcaggactggagctttgtgctcagcctgaggtcagatgtgcttcctgtctataaaggagaggttgacaagaaacttttcaggcttttcctctcaccagttcatttcttgaggatgaaccagttggatttttaattcatcaatggcatggaaataaaatattgattaaaacactggcaaacactcgcatgccttttttgta

SEQ ID NO: 465104 - DNA, 3009 bp, Homo sapiens
tccaggtttgtcacgcaagctgagttcaggctgccaggccgagtgggcacatcaagcacagtgggccaaagcaaaattcagacaaaggcaccaccgaccacagaggtttctggacagaaaagcgacacctgaaggatcctatgagaagagcatcttccttacagaatgcttcctacagtagaatacggtaatgtcctaggccttcatagtcactcacactattcactcactgactcatccaaagcaacttccagtccttcaaatttcattcatatgtcaagccacttgcaaacacctgtgactgctggtgaagttcctgatcaactgccagcccagaccaagccagcaaggtcacatttgaataagaaggaatatcaaagtagcagacatgttttgcaaggaggtaaggttgcaacggacaacactcagagaaggggatcctccaacttaagggtaacagggatgaggaagaataagcaggcagtatcattcacagaagaagaggtgtcttcaaagaagaatgagattttcgtcaggcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgtatgtgttctcttctatgtttaactctagaataactatcttcctgtaacgattaagttaaaatattctttaactagaattgaaataaattgttcactaaggagggggctgcttgtgctaaaaaagccatgaggagggagattgtcctccctgccctctccatcccctatggacttacagtgctgagctcagtcataatgaccaaatttcacagcatggccaagctgcatagataggtgccaaaactaccaattattaatattggcctcttcctaattgaatcagtcaagcagttttggaaaaggctgtcagaaaggagtgagaaatggaaagaggaaaatgtgattgttgagatgggctagctcaactcttacatccaggattttaatagaaaaactctttaagattagagtcaacatataatgagacttttaggtgtttaaccaaaggttcttggttcaagttgcctctaaaaggaagatgataacatgtaaaacgctggggagagtcagaatt

SEQ ID NO: 465105 - DNA, 696 bp, Homo sapiens
attcagtttgagaaaagaggacacaaaagcatgaataacaggaggatggatatagaataccagcatcagcaagtgtacacgatttaaagcacatttggtatctattaccaagctgcccttcagagaggttgtctcgttacacattccacagctgtgactgagaaaccgtcttgtcgcatttgacaatccaggttactatctaaaaacttgagtttgtaagagcaacacgccatgagataatattcgtgcaaatgtaactgacaaaagactaacatcccataatactagagcacctacaaaccaagaagataaacatcccattgggaaagtgtaaaaatatgaacataaagtttacagaagaaaaaacacaaatggctcataaacacacaaaaagatgatattgcttcctggtaattggggaaatgcaaacaaaaactacaatgaaatatcgtggtatcgtgtatcaaatttgcagagcataaaatagattacattcgcaaccagcaactacaacccaaccttcagcctcactggacttcttgccattccccaaaccatatccacgcccctctccacaggctgttccttctgcctgcatgccctcgatggcaccaagggggatgggcacactaacacaactgctgggaatgggaaagtttcaacctcttgggaataaaatctaacagtatttattgg

SEQ ID NO: 465106 - DNA, 665 bp, Homo sapiens
attcagtttgagaaaagaggacacaaaagcatgaataacaggaggatggatatagaataccagcatcagcaagtgtacacgatttaaagcacatttggtatctattaccaagctgcccttcagagaggttgtctcgttacacattccacagctgtgactgagaaaccgtcttgtcgcatttgacaatccaggtatttccgagagtgatgcatgctccttgggaagcattgggaattctgcacttctgggccagccagctccaactgcagccaatgtttaaaaaatagcatctctcccttccttctatatgtacagatcttcagggatttagcaaattctcttaaatagctagaagaccttgctgacttcgatgcaaatattctggccagagaactgaggtccttggatgaaacccaataatcagaggggtcacagtttccttagcccaggaggaaggcagctggtgtctcagcagatgttcctaaaggcctggctttttccacatctgttctgtgtggtagacaaggagaagaggaagggaggaagggaacagagaggaagcagagagagctgaagattaaaacaatactgtacaggtccccgctaaagatggactctctggctgccaggaaaggactgagagataaataggaggagcataagaa

SEQ ID NO: 465107 - DNA, 1165 bp, Homo sapiens
tggacacttgtgatgacatttaaggcccatctggataatctaggacactcttgccatctccacatccttacccacacctgcaaagttccttttgtcatagaaggtagcattcctgagttccagggattgggacatggacattttgtggtgggcattagttggcctgcacagctgcctagagcagacatctctgcagcggcaggccagaagagtgagggtgctcctggggtggagcccatgggaccttgcttcgtcctggagcccctggctctgaatctgagtctggtgcaggtacatctgtatgacagtcagggactgaggaggcaggagctccccaaagaaaagatgtttgaagcactggacaagaagaaagcgggacgaatgttcattacagttccaaagacgctcccacattggtaggtttatgttccatcagcaccccacttctggtactaagctttatatcagctatctactgttaggcaacagccaaaacttagtgacttaaaacagacacaaacatatattatctttcacagtctctgatggatatagaataccagcatcagcaagtgtacacgatttaaagcacatttggtatctattaccaagctgcccttcagagaggttgtctcgttacacattccacagctgtgactgagaaaccgtcttgtcgcatttgacaatccaggtatttccgagagtgatgcatgctccttgggaagcattgggaattctgcacttctgggccagccagctccaactgcagccaatgtttaaaaaatagcatctctcccttccttctatatgtacagatcttcagggatttagcaaattctcttaaatagctagaagaccttgctgacttcgatgcaaatattctggccagagaactgaggtccttggatgaaacccaataatcagaggggtcacagtttccttagcccaggaggaaggcagctggtgtctcagcagatgttcctaaaggcctggctttttccacatctgttctgtgtggtagacaaggagaagaggaagggaggaagggaacagagaggaagcagagagagctgaagattaaaacaatactgtacaggtccccgctaaagatggactctctggctgccaggaaaggactgagagataaataggaggagcataagaa

SEQ ID NO: 465108 - DNA, 1652 bp, Homo sapiens
cctggattacaatcgcctttgtcgtcccagggcggtgtttcagctgcaatacaaatcagtcacctgctcctagtcctcaggcgatgtaccctgcaaatattcacgactgccacgtcacaaggacactcagacttgtggcaaggcccacatggtggaaactgaggcctaccaccaacagccagcaccaagccgtccacgtctgcagcttcacttctgaagccggcgagaccacgagcccaccgggagaaacgaacaactcccaacgtgccgcctttaagaactgtaacactcaggtccgcgccttcattcttgaagaagtgagaaaggatgaagaaaacagtgagcaggggagtcacaagcttgagtattctggtgtacaattggaagctgttgaaaatgccaattcctgggcccaccagctgaccccgattcagtggaaccagggttgggcccaggaatctgcattgaaggtgcttccacagcattctaggtgcttctgacgcaggcggtctctgggtcacacttaggatgcaccgagaatttaaggtcaggtcctcgtggtgggagcaaatcacattcctcacttagtgtgtgccttgcaagctactttctatgcccttacacaaagataccttttttgaacagccttgatttttttcaacatataaaactatctgtttgctgttttttcaacttgcttttttccacttacatagatcatatacagccttgcatacatatcaggatatagatatatacacacacatatatatttcactccttttaagaattattaatgatttagcaattattgttttaaccacctctcaatccatagacatttgtttccagtttttgctattgtaaacaatcctgcaagaaacattagctgtatatatgtttgcatcattatgctttaaattttatttacactctgcttactactaaaaaggacttaaaatagctaaaaattattttttcagttgaatccaaatctaaaagatgccaggtgtgatttaagatgacaaaaaggaagaagagaagaatcaagctaatgtcagaaaatgtataagtgaattaagctaaaatgctaattttgagagggtaaaacagatggggctttgtaatatgtgatccaaaggtttctggagacacttatgtttgaattagaagatactgcctgagatttcttggcagcagaagtggaaagcaaagtgatgttaaattgatttttttttcaaacaattactcccaccaaatcatcctccatcattctatttttaaataccaacaagcatgttgtatacatttaaaatcaatgaatactatttaataaaattttgtatttatgtacattttccatttttgcattttcatactttttctgtcttctcatttctaatgccaacactctctctaggaaattcactaccaattgagaaataaaactgtgccaagacatttgggtaggaaattataaaaatcatccttacagaattatacatgaaatgtttgggcaaaatagtaactccatttataaagtaggaatagataacaaaacatttgaaataagatatatatttatatacccaatgagggctaagagtttctagcactgttgaggttgccaattggtcaaaacagaaagcaac

SEQ ID NO: 465109 - DNA, 1073 bp, Homo sapiens
ggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagtcagacatccacccagtatgttcggcatactccctctattctggcactgggtgtgatgccgcaggggagatgcagaagaagattgtgaggtccctcaaggagtctgcagtcttgtggggactgagaggggaagaggatggcaagaatgagaccagtttcaacctggtgtgtgctgactcctggaagctggacctctttcagtcctgtttgaatgcgggcttcttctttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgaggcccttcctcctgcctacggggaaggggcgccggccacccctctggctgc

SEQ ID NO: 465110 - DNA, 897 bp, Homo sapiens
ggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttctttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcac

SEQ ID NO: 465111 - DNA, 1081 bp, Homo sapiens
tcctcacctcccacagagactgggagatagatttttttcttgacgattatatttcaaagggaaggcaaccaggcctttgagaaagacatttgctagttgtgaaactagcaagaagctggtaaaagttttatatcttaggggaagagaaataatttacaattgcaagtttttaaagctctatttttttttttcttgtaatggaggttaggacctccattacaatattggtataagaaagtctcattctcagaatttgaagaaagtttcaaaaattgtcaaatattgaagatccaaataaacacagttagaaattacaagggggcattccacagactacaaaaaaacaaacaaacaaacaaacaaaaaacttcagaaactactatgaacatctctatgcagaaaacctagaaaacctagaagaaatggatggattcctggacacataaatcctcccaagattgaaccagtaagaaaataaattactgaccagaccaatactgagttctgaaattgaatcactagtagaaagcttaccaaccaagaaaagcacaggaccagatggattcacagccaaattacatcaggcatataaagaaaagctggtaccattcctacagaaaatatcccaaaaacttaagaaggaaggaaatggctattattaagaagtcagaaaataacagatgcaggcaaggttgcagagtgaagggtcagccactgtggaaagcagtgtggcaattactcaatgagcttaaaacagaacaaccatttgacccaacaatcccattattgggtaaatacctaaaggaatataaatcattctatcataaagacacatgcatcaaaccaccacaggaacagaaaaccaaatactacatgttctcacttttaaatgggaactatacagtaagaacatatggacacaaagaggggaacaacagactctggggccttattgaaggtgcagttaagagttttcctcttacaacaacagagtaatcctgaccctataagcaacttcttccaatgaacaggataaatattgtgcttagactgagatgaattttcaacaggtcgcgtctac

SEQ ID NO: 465112 - DNA, 1825 bp, Homo sapiens
ctagagcgctcgacaaatgtttactgagtgcccacggggtgcctagagcctggcgggacgtcgcggggatgcggctggaggaatcggagccggccctgccctctcggcactcgcggtccggaccaggaaggcggcccgagcaggacgggtgggctgcggaccgcggtgggaaaagttgggggagcgcggaggtggcgcggaaatagaaggcttcctggaagcggtgacccttgagccggtcttgcccctcagtccctgtatccttttaagccagccacgctgacccctccgcgcctccctgaagccgttgccagcctgtctctgcgctcgccattccctccgcctggacctctccccactcaccacctcccgcccccatcagacgctgctttctcctcccagagacctccaagacctgccaagctgagagtctccctaagtcactgaggctggagtacagtggcatgatctcggctcactgcaacctctgtctcctgagttcaagcgattctcctgcctcagccttccaagaagctgggattacaagcgcccaccaccacacccggctaatttttttgtatttttagtggagacggggttttgccatattggccaagctggtttcgaattcctgacctcaggtgatccactggcctcggtttccccaagtgctgggattacaggtgtgagccaccacagccagcctaaaaataacttttttaaaacaaacataaattttaaaataacttcttttaggcagtccattccatggaattggtggcactgacctcatctgatgtcccagaaagctggccacaaaagtttccatcccccatgacagacaaacagttctactctggggcaattctccctgtgtccagaccacaaacgcccctgcctgtttggtgcatctcagcagcagaaaatcaccaaccacaaagctttcaggaccggcatttaaaatcaacccaaagacactccccttccacatgctctgggctccgtgcgatctttcatagcgcagctccacgctcctcctcgcagacgagactggcattcaaaccaggaattcttctgaggggctctgtgtgcaggaatacaatcacctcaagctcctgtaaattatctgctccaaggatccacccagaaatccctactgagggtgaactccacagtgtggttgagtccagatttgttgctcggtccagatagattttcagctgctgcatccaaactgcagccagggggacaataagaacagaacctcttttgttctgatgaaactgtttttaatggtcccttctaggccgggccctagtggaagtctcaacaaggctgctcattgaaacgcccttgaaagagccaaggttagtctttatttggcactaactcatcttaaattgtgtgggggaaatggaatacaattcaagttgtattactaatcaatctttgagtagaataaatcacaccaaatgatattctattaaatctgaaagtaattaaaagccatgcaaaattctggactttcatcaaattttgctcagctcaaaccttctaccctgcccccaaacacacctgcttccatcaccagagactgtctggaggccccaggaagcctggagtgatggggtccatccccttgctgcgtgttggggcaccccgcttctttgcacctacataattgtatgggtcccaatgacttttgtggcttggagtctgccttcccctggagaatagaagctctggaagggcagaacagggctgtctcagcacctggcacaaaactcaataaatgcttgtgtaatgaatggcgaagggaatattt

SEQ ID NO: 465113 - DNA, 275 bp, Homo sapiens
ctagagcgctcgacaaatgtttactgagtgcccacggggtgcctagagcctggcgggacgtcgcggggatgcggctggaggaatcggagccggccctgccctctcggcactcgcggtccggaccaggaaggcggcccgagcaggacggatgaggaaattgaggctcaaatacttgagggaacctgcccaaagccacaccaatgctgcggccctaactcagtccagtgtggttcctgacttctcatccacctccgtcatgagaccatctgccacag

SEQ ID NO: 465114 - DNA, 509 bp, Homo sapiens
ctagagcgctcgacaaatgtttactgagtgcccacggggtgcctagagcctggcgggacgtcgcggggatgcggctggaggaatcggagccggccctgccctctcggcactcgcggtccggaccaggaaggcggcccgagcaggacgggtgggctgcggaccgcggtgggaaaagttgggggagcgcggaggtggcgcggaaatagaaggcttcctggaagcggtgacccttgagccggtcttgcccctcagtccctgtatccttttaagccagccacgctgacccctccgcgcctccctgaagccgttgccagcctgtctctgcgctcgccattccctccgcctggacctctccccactcaccacctcccgcccccatcagacgctgctttctcctcccagagacctccaagacctgccaagctgaggttgtttcctcgcctcgcccctcgcacgtttgttttctttcctgtagtttctcttgctgtctggaattgctgtttgagtta

SEQ ID NO: 465115 - DNA, 1200 bp, Homo sapiens
agggagaagttcatgatcaccatgaggggtcatcagcacagacccggaaggtcaacgtctgaaaactacatcactggcacagaatggcggggacccaatttgcttcactttttgctgagcactcacctgacaaagcataagattccagccggaaaggcactgagcacctgtttgccaggccttgtcagcaccttgccgtgcagagcctgcaccagccctgagatcagggagcaaagaacccatgcctctggctcgcctggcttctcagccatgggaaaggcagccttcactgggacaatggcaggtcttgagctaaaaccagtcagcaataagagttatccgacacttatggaagagttccagggtgaggacttgggtcagctgcaggatgcttggattggaggtcactcgcaaagaggggtcacctgtgccttgttcaattcagtgaccgccgggttaaagactgatcagaccagtttccggtgagcatggtgacagggttgctgtacgaagtggccctgaggggcttggccaccatttctgagggtgggtcaggcctccggcccacagcgatcctctgccttcctgcgtagtcatgcctgtcactcaaggaaaaacgtccggatgacacgtgacacagcactgagtgattcgggaatttgcattttctataagtgaccactggtaccagccaaggtggaatacgtgcacttccgtctaccgtcccactgggaacgctgaaaactctgggaggaacataaagaacaactccctgagccctctaaaaagccagctccagctgtggagctgcaccactatgctgctggtcctggtgctggaagccctgaaactttgatgaaagacccaactctccaaccagaggaactggaaatggagtggggtgaatccctgtttatttcttcctctttactgttgccacttggctccaaagatggccccagtcatgtggaactatacaatagcacaaagaattaaaaagctaagaaaaacctgattttctggacagaagaaaactggaaaaagagctccagctgttttaaaaatggggggataatccctgttaatttttttgtcttttcttttaccaatttattcctaaggtagtcctagtcacgcagagctgcatggcagtgcgggaagctaaatcttggagataacactatctttctgtccagaaga

SEQ ID NO: 465116 - DNA, 1181 bp, Homo sapiens
agggagaagttcatgatcaccatgaggggtcatcagcacagacccggaaggtcaacgtctgaaaactacatcactggcacagaatggcggggacccaatttgcttcactttttgctgagcactcacctgacaaagcataagattccagccggaaaggcactgagcacctgtttgccaggccttgtcagcaccttgccgtgcagagcctgcaccagccctgagatcagggagcaaagaacccatgcctctggctcgcctggcttctcagccatgggaaaggcagccttcactgggacaatggcaggtcttgagctaaaaccagtcagcaataagagttatccgacacttatggaagagttccagggtgaggacttgggtcagctgcaggatgcttggattggaggtcactcgcaaagaggggtcacctgtgccttgttcaattcagtgaccgccgggttaaagactgatcagaccagtttccggtgagcatggtgacagggttgctgtacgaagtggccctgaggggcttggccaccatttctgagggtgggtcaggcctccggcccacagcgatcctctgccttcctgcgtagtcatgcctgtcactcaaggaaaaacgtccggatgacacgtgacacagcactgagtgattcgggtgaccactggtaccagccaaggtggaatacgtgcacttccgtctaccgtcccactgggaacgctgaaaactctgggaggaacataaagaacaactccctgagccctctaaaaagccagctccagctgtggagctgcaccactatgctgctggtcctggtgctggaagccctgaaactttgatgaaagacccaactctccaaccagaggaactggaaatggagtggggtgaatccctgtttatttcttcctctttactgttgccacttggctccaaagatggccccagtcatgtggaactatacaatagcacaaagaattaaaaagctaagaaaaacctgattttctggacagaagaaaactggaaaaagagctccagctgttttaaaaatggggggataatccctgttaatttttttgtcttttcttttaccaatttattcctaaggtagtcctagtcacgcagagctgcatggcagtgcgggaagctaaatcttggagataacactatctttctgtccagaaga

SEQ ID NO: 465117 - DNA, 1408 bp, Homo sapiens
cggccgccggccgcagcgggctgagattgttgtcctctgtcaccagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagctacaggtctgttggagtttgctggaggtccactccagaccctgtttgcttgggttttaccagcagaggctggagaacagcaaatattgcagaagagcaaatactgctgcctgatcgttcccctggaaacttcatccccatatagacctgcctatatgaggtgtctgttggcccctactgggaggtgtatcccagttaggctacatggggagctcaaacgccgtgctgggagaaccaccgctgtcttcagtgctgttagacagggacatttaagtctgcagaagctgtctgctgccttttattcagctatgccctgcccacagaggtggagtctacagaggcagtacagtctatcacggcttcccttggctaagaaagggaaatcccccaaccccttgcacttccgagctacttaaaactcaacaggtatgaataaaaagaggaagcaactgtgggtctagtttcagatcacaagaaatctgtatttataccctacttgttccagaaaggattgaaaataacaaaaacacatataatcagaggcattttgtttaaatgaagaattgagtaacatgggcctgtggaaagtactaattaacatcaccttcattcttcactttgtgcagatgtacctgtgttaccttgctaggatggtcatattaaagtaccataactgggtggcttgaacaatggaaatgcattgtctcttggttctagaagctagaagtccaaaatcaagatttcagtagggtgactccttctgagggttgggagggaaggatctgttccaagcctctctccctggtttgtagatggctgtcttcttcctatctcttcttcatattttcttcctatgggtatttctgtgtccaaatttcccctctttctgaggacactagttatc

SEQ ID NO: 465118 - DNA, 1882 bp, Homo sapiens
gttttgatcaatggaggggaaacctgcccttagttaagtttattcccgatgccttacaaatctgattttgtaaatgctgattgcattcgtcaacgcggagttgacaagggctacacaaaagtactgagtacacagaagtggcgacgggcaaatggagatcctggaaaaggaggttttctaccaaaatatccttgtgaacatgaggacagcttccaaactgagaaagagtgggctcgagaaagctctaatgcttctttccctgacacgaagtgcttcgtgcagtgtttggcatcaacatgtcggagccgtggcaacgttctccgtgcatccccgcttgggcgtcattttgtgatggagaacattgatcatattgagcagaagtgggagcagcaaggtctgatggcaaatgcactagcagagagcatagggaccaggggcaagaccaacatcacggtctgaaggctctccctgcctcctcttgcccttttttcctttatacttcacaggtgtgtcccccaatcaatctcttacacatagaatcctgttttggcttctgcttctcagaagaccccaaatgacatagaaggtcttggagaagagtccaacagagacatatattcacagacacgtgtacatctttatgcccacacagaagggtaacagcagccttgcttcagaggccacaccttccaggaaacccttcagcctgccgtgtcttagctgatccctctgccatccccttgcagaaggagcttggagtctctcagctcagctggactagatgaatcttctcagggtcgtcttctcccacctctggctcccagttccttcccccagtctctccctccctgctctgtgtgatcagggaagctgcaaacccaacccttacatcaaaagggaacttgaaaaatacttggagcaaaaactgctaactgtgcatccttgctgtatgctggcgctgatattaaatcaggaaatggcactgaacagccgctccgaacacagaaacaggggttgtcaacacagcaaccaaaagcaatctctaacgggcagaggtgaaagggacctggcacagggccaggaggggggctgcaacccaggaaagaattcctgagctgagtgtgtctgtgccacctctccagtgtccagaatgaagcctggatctcagtccctggcatggaatgcaccttgtctctctccatgagggatgaaagataattagataattaagcatgttgcttaaatacctttgaaattctcctttttatttccatacatgtttaccgagcacccactatgtgcctgacagtccaataaaaaagatgccttcccatgtggagatgaccttctagccctcaggacagaactctgaccctttgacatggcattcaaggtccttcgagtgttggctcctgcagaagctttcatctctgtttccagcctccctgaaatagctccccaagggcacgaggcagtacctttgctccatgcctttgcttggactagtcctaccaccagcaattcctgcatttctgtgtttggcaagtttctgctcagcctccaaagccttaaccaagtgtcaccttttctctgcagcattttctgccaccctccccatttcttccaatagaaccagggatcttttacttgggatccagaagcactgtggacatattgccatcacaacacctttcatgtcacaatggcaaggtttgcactgtcttggaggagaggaaggaagccatattcatccctgaaccctcatctcccagcactggttgtaaaactgaaacaaaaatggaaaaccttgatgaaattcattgttggtgtggctatggggaaacagattttccatttctgatagtaaatgaaataggcacca

SEQ ID NO: 465119 - DNA, 2243 bp, Homo sapiens
gttttgatcaatggaggggaaacctgcccttagttaagtttattcccgatgccttacaaatctgattttgtaaatgctgattgcattcgtcaacgcggagttgacaagggctacacaaaagtactgagtacacagaagtggcgacgggcaaatggagatcctggaaaaggaggttttctaccaaaatatccttgtgaacatgaggacagcttccaaactgagaaagagtgggctcgagaaagctctaatgcttctttccctgacacgaagtgcttcgtgcagtgtttggcatcaacatgtcggagccgtggcaacgttctccgtgcatccccgcttgggcgtcattttgtgatggagaacattgatcatattgagcagaagtgggagcagcaaggtctgatggcaaatgcactagcagagagcatagggaccaggggcaagaccaacatcacggtctgaaggctctccctgcctcctcttgcccttttttcctttatacttcacaggtgtgtcccccaatcaatctcttacacatagaatcctgttttggcttctgcttctcagaagaccccaaatgacatagaaggtcttggagaagagtccaacagagacatatattcacagacacgtgtacatctttatgcccacacagaagggtaacagcagccttgcttcagaggccacaccttccaggaaacccttcagcctgccgtgtcttagctgatccctctgccatccccttgcagaaggagcttggagtctctcagctcagctggactagatgaatcttctcagggtcgtcttctcccacctctggctcccagttccttcccccagtctctccctccctgctctgtgtgatcagggaagctgcaaacccaacccttacatcaaaagggaacttgaaaaatacttggagcaaaaactgctaactgtgcatccttgctgtatgctggcgctgatattaaatcaggaaatggcactgaacagccgctccgaacacagaaacaggggttgtcaacacagcaaccaaaagcaatctctaacgggcagaggtgaaagggacctggcacagggccaggaggggggctgcaacccaggaaagaattcctgagctgagtgtgtctgtgccacctctccagtgtccagaatgaagcctggatctcagtccctggcatggaatgcaccttgtctctctccatgagggatgaaagataattagataattaagcatgttgcttaaatacctttgaaattctcctttttatttccatacatgtttaccgagcacccactatgtgcctgacagtccaataaaaaagatgccttcccatgtggagatgaccttctagccctcaggacagaactctgaccctttgacatggcattcaaggtccttcgagtgttggctcctgcagaagctttcatctctgtttccagcctccctgaaatagctccccaagggcacgaggcagtacctttgctccatgcctttgcttggactagtcctaccaccagcaattcctgcatttctgtgtttggcaagtttctgctcagcctccaaagccttaaccaagtgtcaccttttctctgcagcattttctgccaccctccccatttcttccaatagaaccagggatcttttacttgggatccagaagcactgtggacatattgccatcacaacacctttcatgtcacaatggcaaggtttgcactgtcttggaggagaggaaggaagccatattcatccctgaaccctcatctcccagcactggttgtaaaactgaaacaaaaatggaaaaccttgatgaaattcattgttggtgtggctatggggaaacagattttccatttctgatagtaaatgaaataggcaccatcttgttagaggctaatttgacattattaacactgaaaatgcacacatctttcaacccagcaattttatttcttgctttctagaggaatgtttgcccatgtgcagaaaggcgcatgtaaaaagctgagttgcagcattgtttgcaatagtaaaagatttgaaattgcttaaatgtcggtcaatatggcctggataaaaaactatagggcatccattggatagaatgctatgcattagttaaaaagaagtagatttccatgtattgaccaagcatttgctgagtaaaaatcaaaagcaagctgtagctctagacatagatgttaaaattacattgctgcattttttcacaatgagaatgtga

SEQ ID NO: 465120 - DNA, 3907 bp, Homo sapiens
gaatatgtttctatttaagtagtcatgaacgaaaaagtttactatcttttcctctcttttcctctctttgaaataaccctggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagtgaggcccggcacgccccgccgccccggccccgcggggggaaccactgcgcttcgcgggggcggtggcggcgaccgaaacaggcctcgcccggcggccctccctacgcgggaaggaaagggggcggggagaagagcgtagagccaagtgggccggatctgggggccgggggagcgggcgatgcggagcctgatctccgctgtttcccgcaagcaagttctggtgccacttcgttgctgccgggcgctcggcagtcctccatccgccctcctcctacgcaagcagctcgctccgccgcgggctcaatcccggccactgcagaaggggcggcgtacagccaccttttccctcttcgcgcacaccttgcaagcccaggaaaagttcctctcaggctcctcgctttgccttacctctctgagtagggtctccgagggtaaccggtcgtgccttgtatagggtttaatagaatggcttttaactaaaggaagagaatggttgtcctcttgagtccgcacgccatgctttccggtcgctgtcatctccagacccccatactataggcgtttgcatatgatgatgattcccaatttactgaggccctgatgtgtgccaggctgcgtgcgagcatgtttacgtgcattcgtgtgtagtcactaccaaggaatgcatctgtctacatacatagccagggattcttacctcacccctgcgaggtttgagtgattcatttagtagataagattttataagggtcagcaaggtaaagcaccttcccttagggcagttttctccctgctgtgggccttcctacccctaggattcactgcgtctgtggcttcctaccctagacgctgtagttgtgggcttgtgttgacttacccggataatgtttcttctcttctttaataatactgagaacttcattgttttgactgttattcatttacttatgtgttgatagacccacagttcctttctagtggctatatcccgcacaaagcctataaagatccattttttggaagggtttaacatcaaccattctagtcttttcttcctccctgcacagtcattttgctttccctttggtagtctttcactgacacagatcttttccttgccctctgcttttccttccttcccccatccccaatattggagactgtttacctaggggagtataatctaatccacaccaattaaagtagcacttcggagtagggaataaatctcgaaatcacattcaatttgctgttttatgtaaaccacatattatctatgttccagctttactcatctatggcattctatttagttatgtagtatagaattggccagtgtgctatatagtgctctgagagatcagtgaaggcgttttaggtgatgatatcgctctatattgaaatgtacagtgaggtcttggtgtgtcatgggatatcagcttttgacatttccagttaggctggtgacatggcacgtaaacagttggcgaacgaatttccctttgggctagagccagagcaagaaagtgagagtgatgataactttggttactcggaacaacctaacagcatatcttgcaaagacaagttttaaagaccccattggattggtgtgattgtaacagcagagaaaatatacaggaatcagttgaactcaatacctcaaaccctagagatggggctgtgtttgtttgtggttcttctttagagagttgggaaatcaaaccttccaacctgccacaagagttgcaataataactgaaacgtaggggggtgctttacagtttaacaggcgtttatctcctatgaactctgtactattcctaggttccctcctttaaatgtcttggggccaagcttctcagttttgaaagcacattttaggaagctttaaaatgattttaatgtggtgcagagaacccaatgttttctaaatccctttctcgcatatatttgtgaaacagggcgaagtctaaaaatggaggaagatctttaagagaaaaactggacaaaataggattaaatctgcctgcagggagacgtaaagctgccaacgttaccctgctcacatcactagtagagggtaagcgaatccacttgctaactagaaggaacttccttcttggaaaatggataatatttagtggccagatgtttggtcgttttatgtcagttgggcagtttgatctttgcagagaatatagccagatgtgaatggaattatttcatggcaaaaagaaacatttgcatgtactcctatacctccatccttcttccttcttttcctctaccataaagttacacctccccagcctaattctgagctaaacaacgcacaagtttaagaactgcacattctccaagtttgtctcctttaaagggctcagcagtaaataacttaagttattctgacactgcgtttagaaatgcgtgaccattacttcctgaattaatttggaatcttgacctgcgtccttgatttaagaccatcctgaaaggcttcagggttatgtgcctttcaggtctttgttttccaaacatatgctcccttatctctttaattgtgcttttctcttgagaagaagcaaaagtgaggcaatttttgattctggatgatgtggatatggaaaggtaaatataagcattggaaaaagtttctcctggtagctttaaacatacatacaccctccaaatgcctcaaaacaaaaagccaacccttatcctcactccctgctctagatctagattaagtttttctgatacagattggcctaggttttggtgtactggaatgaatctatagctctcctgtgtttttctttgtgtcctattgtaaatatctcatgctaacagggaaaaaaaagttactttaattaccagacagattttaaaactagcatgtatatatatttaaagaagtcattttatttcattcacatcttgtatttgaggagatatattacattgaatttaagttctggctttgtaaattattttttaaaatgtttaaaaccatatattgaggaggaatctatgaatctctttgttgatgtcagagattgatagtaatataactgtttagaaatcagcaattgttcagtgccag

SEQ ID NO: 465121 - DNA, 1095 bp, Homo sapiens
cggcgacttccaaggagcaggccaaggtctggtagcctctttagtgctcaaggtcacccgtagctatgagcatcagtggtagacttaggctgtgtactggggagagaaggcaggcactttcccagaaagatggtggtctggagctccagagcgcggttgcagactggaagtggggacaggagcgggagaaggaggcttcgacaccaactccctgggggtctgcctcatgcagtcccctggatgtcaccggagctcacttctctttgagcacctggctcttgctgacagactgcttggtgcatggtgggtgccacgggccccaaggagggcaagttgcagacgtggcagcagtgcacatgaaagcagccgcagggcctgaacgcgaggctgtaacacgatgcgtgcgtgaaagagagtcacacgggcctgcggcagggggagcatctgtggcacagagcaccgggcaccggctgtggaagttgggagcagagcacaaaagcagaaagggggacccgaagagacctgggcaggtccagggagccagtcctctgcccggctccttcctggtgccaaccacagtggcgattgcattggggccctggacagccttgccaggctccctcaggagcctgtcactccctgaggacaaagggctgtcgcaggggttaagtgagagcacagtggcaatgttcttgggccagttcctggaaggaacgtagcacattgcccggcacagagcaaatgctgaggaaagtcacttggggctgtcttcaggctggatcagaaaattcctctttcagcaaagacaccatctggcaagcgctctgcagtctccgccatcctctgtagttctgccagcttattactgttttgttttgttttaaaaatatagatgacatttatcgagtactcactgttatttctcccttaattctctccacagccccatgagtgggtggcgatgatctatggggtttccaccactgcacactgttcacaccagtctgaccgctgataactcctctactcccaacaacagatctccctattttccttttagttgaagatgaaattcatatttctattatctactat

SEQ ID NO: 465122 - DNA, 585 bp, Homo sapiens
aatgtttctctattcctggaaggtgaggatttccaggttaccaaatgttgtttctggagagggagagtccttggattaacaatgagaagttaaccaccttgccaggctccctcaggagcctgtcactccctgaggacaaagggctgtcgcaggggttaagtgagagcacagtggcaatgttcttgggccagttcctggaaggaacgtagcacattgcccggcacagagcaaatgctgaggaaagtcacttggggctgtcttcaggctggatcagaaaattcctctttcagcaaagacaccatctggcaagcgctctgcagtctccgccatcctctgtagttctgccagcttattactgttttgttttgttttaaaaatatagatgacatttatcgagtactcactgttatttctcccttaattctctccacagccccatgagtgggtggcgatgatctatggggtttccaccactgcacactgttcacaccagtctgaccgctgataactcctctactcccaacaacagatctccctattttccttttagttgaagatgaaattcatatttctattatctactat

SEQ ID NO: 465123 - DNA, 567 bp, Homo sapiens
ctgatcctgtgttctcactgcctcttgtactgcctctccgtatgagtcaccctgccctgccagtcctgcacattttaccaaacatttctgttatcaatacacagatccatactttacccttccagtttcatgaacattgtatgaaacaccagaacttcccatttctaaggaaactcaggatatgttgtccactccagaagtatgaggtgggactgcaggaatatgagctcctctccacatgcagggaccccaggtgcttatccagcctgttcgagatcatagccaccaagggggaactctctggacaacctggcagaagttcccctcactcagctgaaacctgcctccacctgaggccacagagcaagtctccctgggcttctgggtcttcagacatttggagacagttattatctctccctgccctcagatttaccatgtccaggctaaatggatgatttctcacttataaatgtaaggcatttaataattacatttcttgataataaaataaggaaaaatttagggtttttaaacaaaaaattgcattggtatatgtctgctgtt

SEQ ID NO: 465124 - DNA, 877 bp, Homo sapiens
taagaatttagcagagtttgtttaccaggaaacagaattctgaaagaagaagaaaaaaaaggggatatgtcctggagagaaggtagcaaagagaggctagctggggaggcctcacaatcatggtggaaggcgaaggtggagcaaaggcacgtcttacctggtggcaggcaagagagctgtgcaggggaactgcccttcataaaagcagcagatctcactgagagttacagcattgaagcccgggtttctcaggcctttgaactcacagtgaattacaccactggctttcctgggtctccagcttgcagacagcagatcacaggacttcttggcctcgtaagcaactcccatctgcctttcaccatgagtaaaagcttcctgagacctcacaagaagcagatgcaggatccaagcgtcttgtacagtctgcagaattgtcccactgcaattcagttgaataagaaagaaggagaagctgtgaactgtaggtctaaggacttctcaaactttttcacgtacatggagtcaccctgggctcttatcaaaatgtagattctgattcagtaggtctggggagctgctgctgctgctggttccaaactacgctggattaaaaagaggcaaagaagcagaagataagcacagggttgcctgggatgaagtttgctcagccattaaaaggtgggaaagtctcctgctgctgtgtatatgagagaaagccactgttaacgtcatgtgtcagctacccatcaattgaggcagaggaagcaattggttcatcaatgggttggtaagaagccctccaaaccttaattatctgagtgcccctcagtttcactgggcttgtcactgactccttacaagctcagaggcagac

SEQ ID NO: 465125 - DNA, 681 bp, Homo sapiens
tatatactactatgggacagtctccaagatttaagtccaaaaagcaagataaaatgtgtttagaatgctattatttatcaaaaagaaaatgcgatagaaaaagtctggctttgagagataggataagaaaacaaattcctggagaagctaaaggaagtcatcttttaatggattcaggaaagagaccttcaactctggataagaacagtgtttcaggagatcacaaagaggtagaatgcaaccagaaagaaaactgtggccctactgaactgaggaagaagaggtcagagttctggaatcagaaagagcaagtaggaagggtgctgcacctaaggactctagatccttggtttgggactgggcctcacacatgtaatgtgaggctcttgagactgaggaggactgctgttcggtcaggatcagaaggaatatgctagagttcaagccaccatgcaagatccgtgagcaactccttaggtgaattgtgaaagacagccaggtatactctttgctattgcaaatggtcacactttcacttctatccaagacttactgttgattttacctttcccctctgttttcattatgcttgtgggttttttcctgaacctttttcactctgtcaaaatgtgtgccagggctctctgggaccattatccaaataaaacataaaaatatttc

SEQ ID NO: 465126 - DNA, 638 bp, Homo sapiens
tatatactactatgggacagtctccaagatttaagtccaaaaagcaagataaaatgtgtttagaatgctattatttatcaaaaagaaaatgcgatagaaaaagtctggctttgagagataggataagaaaacaaattcctggagaagctaaaggaagtcatcttttaatggattcaggaaagagaccttcaactctggataagaacagtgtttcaggagatcacaaagaggtagaatgcaaccagaaagaaaactgtggccctactgaactgaggaagaagaggtcagagttctggaatcagaaagagcaagtaggaagggtgctgcacctaaggactctagatccttggtttgggactgggcctcacacatgtaatgtgaggctcttgagactgaggaggactgctgttcggtcaggatcagaaggaatatgctagagttcaagccaccatgcaagatccgtgagcaactccttaggtgaattgtgaaagacagccaggattccttcaacctacacagtgaccaacctcatctcctccaaatttcaggttgtgctgcagcctaatcaatcagcaatctgaataaaaataaaactggaaagttatcctttccaatcaccaactttctcagttcacctt

SEQ ID NO: 465127 - DNA, 2237 bp, Homo sapiens
ggacagtcagaccacagcaaatggaggtggaggtggcatggagtgggcagagaataggagacttgagctgagccttgacggatgagcagagtagacaaaacagccagaaaagccaaggaggtggggcagacaaaggtaggagactgctacatcaagtcgtccctttttctgcttgagctatgtcaccagggttttgggcatgtctgtgtcacctggaatccaagtgtgattgttttcatccagacattctaccaagtggaaaccaagagtggaggctcagtccacagccaagcacagagctgcggaggggctgaggtggcctctgccggggaatggaaaacggctctcttggaggaactgaaggaacccccacttccgtcttctgtccctggtgcctgcatggcaggaccctgggaccatgagctcacaactcctccccgggtcactgtggtggacatcaggatcacccctcggtgctcagtgtttggatagggcaccctcacgtagcatctcccccacaggccacccaaccatagctaggacacctctctttggctggccatcacctccacccactctatttgacagtcgggctgtttgttattgtgtcgggctgagctgggggtggggctgggggtgcagagaggcactgcatccattctgtctccgggtgaggagcagctcagatggccccggtagcagaaggaacagggatgggaccagtcctggttgaatactcacatccaggtggccacagcatgacataggcttgagtgaactgagagaaccagcctggatggcagagcttttgtttcagctcacctgcactgaagctgtttcccaagaggatgacccgggtgcctgcctggctaagtaacaagcaaacatttcggagcctaagtttgggaaagagcctgaaggcccctacaccctgaagcaacattccaagccttgctgctcacaatgcggtcccgggaccagcggcagcagcagcagcccaggacgcttgttagaaatgcggcacctccggccccacttcagacgttctgaacccaaatctgcattttatcacgatcccaggtgattcatgtgcccgttagagtgagcgaagccctggattagagaacagaaattagacgtgacccttcctttgacaggaatttatcaccaggctctatctcaagaactgtgagaattcggttcagatgtttgtgataactctgcagcagtaactgactagcgtggtggttctcttccctgactgggcgttggaatcagcgagggaagttttaaaagatgttgatgtgcagaatttacccaagaggttgtgattcaatgggtgtctgggaaggggctgggacatctgtgtttacttagagttccccaggtgattctactgtgcagccagggctaagaggccctggggtacaaatatcatcttgaatggttagacttctttctgaatgggagtgatgtaatttccgatttgcccaccgagcacagcatgctgggccctgaggatgttacagaagtggataccattattgctctccagggacaattcatcgaggaacaatatggcatctgcaaggtgaaaaaagagcgataacaggagatgccgcaaagtgtggcttccagacacaagagtgtgctgggaggagagctgaggaggatcccatccagaatatcatgttacatttagtcatcatgtctccctgagctcttcttggctgaccatttctcagtctttctttgtttttcacgaccttgaagagtactggccaggtgttttgcaatacacccctcaatttgggtgtgacatattctcttgattagactagagttatgggtttagatgtggaaattcagcagaaacaacagaattcacatacaaagacttctgattctggaattatcaaacaccgaatataactgttttcgataaatgaaagagcatctttaaaatatgagtaaaggcagagggagatatgatggtgtttagatgcgtgtgtaatacagaacaaaggtgtggttagacagatggcccgacccagagcctgtctggatctaagggctgagaccccactgtgccctgttccaccttctgcaccaccacagctgtgactgctgaaattcaaaagtgtatcacagacacaatacattgagaaatcttggtctacacatttgaagagcaggcaccacgggtggtccaaagggatccagcagaaacatgacag

SEQ ID NO: 465128 - DNA, 815 bp, Homo sapiens
tcactttctttccagtgttctctctaagaagctcgagtcagtgttcggttacctactcactcttctggtctttctttgcgaaggagatttgagaaagtccatgcatgggagcaggacaaagagaaataatctgatcatccctaagaggtttcaagaactaccaggaggaaaggctaggtctgctggtttgcagagactacagccacccctccttctaggggctcaggcccagggagatccgggttctgtccctgagcctaaggctggagttattggagttcctcctgcaggaaagccctgcccaatgatgatgcacgggtcagggtcaggcctgaaggggcactctggccacagactgctacggccaggagcttactgtgttaggcagttgccagtcccagtgctggctgctgcccctcccccaaggagctcaaacagcttagaaagcaggcagccacagctgcagatatgggtcaccccttcccgcaggtgtttggctgtagccctaggacattccacagggagtgtgtaggttggctcaaagataggagggacctcaaaagggtattaagcatgcttagccaccagctttaggcaagtgatacttgaaaaaattcgctgactctatgtcacttgccttgttaaactattaaatatcatgtatacctgtaccaatttggaaacttcccactgaaccatcaacaacagtgttccccagcgttgtatatgtgtttcagtgttatgtgcgtgtatgtatgtgtatgtgattttgtgttcgtgcttgtcctatttcggacagctcatggtatgcaatc

SEQ ID NO: 465129 - DNA, 397 bp, Homo sapiens
gtaagaagtgtctttcgcctcccgccatgattctgaggcctccccaaccatgtggaactgtgacgaaacttcagctttaagaggttaaaagacttgtccagagtcatgttaacagcagaaacagatgaactctcaagaaataaagatctcgttttcatggaaatcatctcccaagaacaagagaaaaaaataaagaaaatgtatgagagacttgggattgctgtaaaagacaacaggtgtcagagttttctatgaagacttcactattccttgagctacagcttcagacacagccaagtataatgctcttgcttcatgaagccaaacagccactttcttctctggaatgttaatctgctcttattggagttagcaaccccaggaggatcgcttcctg

SEQ ID NO: 465130 - DNA, 922 bp, Homo sapiens
gtaagaagtgtctttcgcctcccgccatgattctgaggcctccccaaccatgtggaactgtgacgaaacttcagctttaagaggttaaaagacttgtccagagtcatgttaacaggaactaattttgaagcaccagaatgctgtgaattggctgtaaaacaatgttgaagaaactcaacatagaacagaaggcacactttccttaggaagaatgctgataaaattttaatgaactaacatgttgtcatggggatttgttgctattcattaattcattgtgctgttcctctatagttttgctgaagttgactgacaaattgtcaagatgaccggactgtcaaaacaaccatgacaaactctcacatcaacttcgactgcaagtcaaagctgcatctggatttgtttcttagcacctccccgggaaggctggaaagaaaacacggagaaatagaactccagtatggcggaaaatgcaggcattcaagggagagttgtgagaatggcccacgtcatcgccatcacctctcctcttcttcatttctactgcctgttctttcgacttcctccagtgaagtgctaaagaaagggaagaggaaaggggtgagggtgggacagttcagtctaaactggccgctggcaaaccaagaaaaagcccagaaaaatcaaagaattcaagaaaccctggtcactcacattaatcaacatttagacctggaatataaggcaaacataagacgactctcaatgagaaagagaaaaaggcagactagctagggacttcaggaccccaaaatagacaacgtggtaagatctatgtgttttctattcacctcatatattccaaacatggtgctgaagatgctggcaacttagaaatgccaaataatgcagaccaaaaaaaaaaaaaaaaaaaaaaaaaaaa

SEQ ID NO: 465131 - DNA, 1621 bp, Homo sapiens
gcagcctaactgcaagatggggcaaggaacccccctttaccaagatgcgtgtaaagcggttgttggtgatgtgtattttggctcatcacggccacgacacttctctggtgaaaggcatcatttttatggaaaggagcgtggaggaggaggaagacaccggcttagaaaacagaggtgacagccccctgcgtgttattggccctgaagactctccagtgggacaagatgtggaagtgaaagacagtgatattgatcatcctgacccagtgatgctctggtattcagttggtgacactggattctctccatcatggagggggtgggcctttgcttgggaaaacacaggctttctgcatgtgggttttcctctctatgatcgtgcttttgccggcactattatcccaacattgcctctgattaatgtgcttattgcacagaggacatgcgttgaaggactcaggcccagaggactcaccatactacacctagcttccctctcacccagaagcagctaacctgatgaaacaaatgccctggccttaggaagacttagctatatcctaattggagccaacacccagaaaaaaagaagcactgtcctaaagatagtagatgatttgaatcagcgtgtgatatggggtgctgatttttccaaagcttgaatatatgggtccaggaatcaaggaccaagtgggagtgttttctccactattacacaagatttctcacttacagaatttttatattcttcctctatcaagctctactacctttggttccaacggaaacatgcctgtaccagggccagcaccctcgaacagtgactgacaggagctggtatttatatattccagattcttctttggctggagacaaccctgaggtgtgtgtttcatgctatctgaaacccccgtgggattaaactcctgttgcatgtagtggtaacgagtttgataacacattctgcctacatttttttaatcttatttcctcctcctctactggtggttcctgaaactcttaaataaattgattagactcaaattcttgtcttgtgtctgcttctgggggaaatccagtctaagactgttgagcattttattgtgggtttttccaactttgcattcccggaataaactatgtttatttcaagtgatatattatatattgctgggtttgttctgccattattctgtggatgatttttgcacctacatccacgagttagattaacctgtaatggtcttttctctcacactgtcatggtcagaccctctagcaagataatgcttgccttataaaatgtattggagagcattccttgtctttctattgactgcaatagttggtgaaagactggaattattacttccttgaatgtttaaagatatgtttggagccatccatggcttcacatattttatatagtttttccatcctgtagagtgtgtatataaatacataaaggcctctaaggtgctgcttcttcctgatctccagatctcatcaataggacatcctaggggacggtcaggctgactaaattatggcttagatctggaaaatcaatgcaacttggaggcaagattataatgtaaaggtacttccatcccttccaggt

SEQ ID NO: 465132 - DNA, 2086 bp, Homo sapiens
attgagggttaatttttatatatggtttgagtaaaacagagatatgcagaaggaaaaccaggagaggattcttatccaggatgaggaaggatttttctattatcttaaaacatcaaatgattttttttggttgacacggtgttatatccctacacctcactgtggattcaaggaagatgatagtggtgaagctttggatgttggggtaaaggaaagaacaggtgtctggattcctttgttgacactcgttcatggaaataatgagatctacagaagctgtttagtcccactctatgataccttgttgacccctgctgatgagagtataagatccccacttttacttgtgggttgctggaagggtgtggaggggcagaaggaagaagcaaagtggagtaggaagtgtgagaatgtgcatgtaatctacgcctatgcagcacatccaggcacgccagcttcaactcgcttcatcatgagagaccaaaaataaacataatgaaatagaggacattctcgcgcctcaaaaaattgaactatcttaaaagtttacttttgagaaatgtgagtcacaaaaagtaaaacaacgtactcaaggtcacaccgctgagaagtgtgttaggtgagacatcttgaagctcttccttctcatgctggaaaggctgtcagaaagttcaagtcctcctcttgacatagtacatgcctatttgctcattgggataggctaaccttttcaagcaatgtgcggcaccccttagcttcaataaagtgttcaatgtaagaagaatatgctctgtatccataataaaatcaccacaaatcaaaaaaatgaccaagttgcattccctagtctaattcttaatccttggagtctgtctctttttgcatcaaaaatccaggcaatgacatgctaggatccccaccaattagatagtgttgcttgatcaagacgtattttctcctgatttaaatgctaaaaagattggaacagtgtatgtcaccatgactgcatttattgtctttgttcaatataatcttgatgaacaatacatcagttgatgaaatggcctgaactcatctttaattgttgctgccttttattttattcaacatttagtgtgtagatctatagcatcatttaaaattgtttatcaatggtttagcaaacatactgtacaaaagcaatatggaaaacactggaaacaagtattaagagtcttcctgctcaggtttatagagattaaggaatgattcagagaaaaaataagatagattgaaaaaagggaggattttttaaagtagcacagtgaaataataatgtttttgaaattataataccatggactagcgggcggttgcaggagaagggtaaaactgtttcagaagttattatgtcgagtataaatttactgataaacagctataacagcagaaataacaaatatattaatatgtccattaaatgcttatttgccaatcaatttcttctatttattgtgatacacgatcactataaacatttttcaagagaggaaaataagtctaataatttaattaatttttcttgaatcatgcagccaaatatgtgctggggccaaattcaaattcagatctgtctatccgcagggttcaggcttttaaccattaagcatagtttaaaaaaataaagtctgcagtccccaagtttacagcagaactagagatacaacctttgaacacaggtacccctatttggcatccatttcaacagaaccgcattttcttcatctcccaaagcagacaagaagaaatcctaagagttttctgcaagttaactatcaattcaaattgcctaaaacactcatagaggcattgattggaatctgtttgaagtgtgaagttctgaaagaaggaaaatgtaaattcctattgaaccgagactaaatcattttggtaaaaagattgtattttaagaagtacattttgtgaaaacagaaagagcaactcattggtaacttgagctgtttttttaaagatgttaaggtgaaataattgctgttccagtgcccctattcaattattttgtactatgaatatctattcttcattt

SEQ ID NO: 465133 - DNA, 2567 bp, Homo sapiens
cgggtccaggcttaagggtggagctctcatcagggactctgccctcctgtctcctctcgcactctccaggaaaagctgcctgctagataacatgaagacacgccagcagcctcatgggggtggagggaagagaggcctcatggtgagggactgaggcctcctactaaaagccagcactaacttgtcaggcatgaaagtgagccacctggaagcacatcttcagcccctgtggaccctttagatgactgcaggccctgctgacatcttgactgaaacctcatgagacagctagaaccagaatcgcccagagagaagaacatcaaaggtgcgggtttagggcccagaaagccactggccccttaatatccagaaaaggacaaaaactcacgggagtcaagcactgtttgcctggaagaagaaagataaagacacagacaagccctgctcccccaccagccaaaactactattctacctgtttcctgattctgacccacgtatattcacttgtttcatcattttctcattcaaaaatatattcattcaattaataatgatttactgagaggagaggaagcgaactatgtggcttttggaggaaggttattccctgcagggaaacagtgcaaaggttctgagacaggaacgtggctataaggtttgtgaagaatcaaggagaacaggccatcggagcagcctgagccaagagagggttataggaaatgaagatgaggagataacaggccagcaacgaggacagatagtgctgggtcttctgggccactatgtatctgcagattgctttgttctcctgcgaaaggattcctgcatcattgaagagaatacacggaagaaaaaattctggcatttgcttaagccaaaatatttttatgacacaaagcatatgagagaaaaactgattttgtatatggtatcggacggggtagagtttcactgtttccatatttccagcatactaaaaaaaagatgaatatcaaaattatcattataatttaatattttttccagaatttttgtttcatgaagattgtggaatcataataggtatgtactccaaactcattttcaaccttaagattgtgcaatccccaaaccctatctactagccaagagctttgccaatttgattttctagtaagacagaaaattctattgcaaatttatcctgaggcttataaccagtatgtattggcaagatttaggaagacaaacataaaatgcatgctctgtagcaaagcaccctcctgaattgcctccatatttcctagcaaacataccgagagcttttatacccacagtatataaaactatgagcccagctcatatggttcagcatactttcacaacatacattaaaagatattacctgtaccttgtaacatgtttgcaattttcccatgaattagcatttattttcaataactcagagagaaagtctgtaatgcttataaattgatttcttttggcatgctgatggaatgaaacagaaactaaatgcataggagcatcagtgaaaagatgagcataaaccttttgtgagaactgtagctttaaaatcacctaaattttcttctcttcagagagagagaaagacaaagagagaggcaaacaaacaaacaaaaaatcatgaacattgagatttgagttttatgcttgggctacagttatactgtgtcccataatatacttttcttggtagaaccaagattatttttgagcagatatttaataacgtattcttccattaggtattattccctacatatgctttaggttatgttcttttacttaaaacacaaggttacctcttctactagaaaattttaatgaaatgtttcctgatgcagtgatttgaaggctgaccctgaagaggcagggtttcctgtgtcctgttacaatggatttttcatgtcctgggatctccaaaggatacaggagcatagtggtaaattcagtcttgctacagagagcttacatatgtatgtacacttccctcacctttccttccaaaggccccaggagcagatgtttgcagattgatttatgctccattatatttagctgtcacttcacccagaactgaaaagcagtcatctctggagaaaatatgacagtagtttaatgaagcacatggatactgcaacgaagggcaggaagtgaaggcgcgtgtgaatctcaacctgctatcatagaaatgtaagaatggtttttctgtcaggtgttctgtgaacaaatttggaacatggaattaacattcagagaggactttgtaacagcacccctctgtccccttcagctccagacacacagcctttcatgacccctggtgggtgacaggcatcacccctcttcctgggcctcttcaggaaaccctcttcacaataatcgctgccaaatcaacctggaatgttgctgttaaaagtgatagaaagctgggaatggtggcaagtgcctgtagtcccagctacttgggaggctgaggcaagaggatagcttgaggctaggattttgagaccagcctgggcaacatagggagactctgtctct

SEQ ID NO: 465134 - DNA, 2793 bp, Homo sapiens
ggcaggaaacagtggtttcctgttcatatcctgcctgagcctgggccgggtggaggtgtcctgcatggagtcttgtgaaatcgcgtggactgcaacacccagcagcgcgccgccctgggtcctgccactgagcagctgttggtaggctctgctgtgaggtctcctcttccggctttcccacttcccaagtgttggttaaggaatccagatgttactgcaataaccactccataaacaaaaggaacacccagctgtgagaactggcttctcagcattcgtcccagcagaggctcttctggggccagccctggaagaacccatcagggttctgatggttgccctgtttcagcacagcccttattggcaggcagacggctacgggcacagccacaggctgaagtgtcaacacttcaaacaacacagacagtacaatgacaaattggagatcagctctaatctcggcccccaatttaatgcattgctgaatattcttctgaacatagtccatcccacactgtcccatgacacaagacgctccaaggggctgaagatagagggacttctgcagtcaagagagctgggaaactcttggacagtcacaatgtgcatttgggtattaaaggctctgcaaagttctgcaccaaataaacccttggattggcttgatccaatgccatgtttccaaaacctacttgcccgtgggacaccttagtccataacacaggttggcatttcttctagagagtgtgctgtgaaaaacactggtctcacagcaccgtgcattcatccagcaggtatttaccaagcagggactttgggccaggtccgtgctaggctctgcaggtggaccagccagccctgacctccatggtgtctcttctcatgggagaggctgcacagcagtcattgagaaaacgaagaaacacacaggtactttcagatgctgataatgactaccatgtgctaaaagagctccaggtgttgtctgttttgagacaatcttctcgacaatgagatagaatgaaccatgcaaactttgggggctacgatggttttaggaaagagctagagtgaaaaatcctttgacatatatacatacaaataaagatacatgtgtataattttatgtaattgacatcacattatatgctggcacctgccttttttgcttaatgaaaatgtcaaaggtaatattaccaatcaatcaatatatttcaccatcgtgtttaatttctgcagagcacttattcaagcacatactgcatttttcttagtcactcactggtgggaatagaaagttttctcaggcatgcatttttcccacttctgaaatgatctccttagaataaattccccaaattgtattgctgggttcaaaggcatgaacattttacatttttatacaataatgtcaaactaccttccggaaatgatgctcactttactttccctccaagactgtgtgaaaatgcccattttcctaaatgcttactatgactggtttccaactacattttaattcttgttcaatctgataggcaaaaaatgatatttaatttttatttgattgataatgaccttgaacgtgcccattagccttttgcatgtattcttttatgaaacatctgttcctatccttcgtcaatgttcctcttcatatgttaacttttcttattgatttgttagagcactttgtatattgtgaatattagcttttgtgatcagaattatggaattgttgttgtctttagttttgcttatcaagtttaaagccattcagagatgttgtaaatgtgtatgttgttaaatttatgtcttattttgtgttttctgatgctcatatgtttagaatggtcaagcaatcccaacttatgattacttaaatattctcccatatttgctcttagcattttttttcttttcatgtaaccctttgttctttcaggaatttactttgcggtaagaaatgggctggcttccagttttatgtttcccaaatggtgattcagctgttccatttccatattctcccttattagaaatgaccactatattatgttctaaaatatctgcgtacttgtgtcccttcctataatctcagttcatctctttgagctatcttttgattcctttttcaaaccacactgctttactgaactgtcatcatcttatacatttttaatactcagcaagacaagtttctcaatgccactctttttcagagtttttctggtggttgtaagatgtttattcttctggataaactttagaatcactctttttgtccaaggtaaaatatatcccacattgagatcatactgaatatacagactaattcaggaaaaaatgtatgtctttattgcattgagtcttcttatccaataaaaaagatatgaatttccatgtattgaaatcttcactgagacttatttttggcttttcacatgtcctgcaaatgtattgttaaatttatttttaggtattttaggggaaatgattttctaaagtttgtattttctagcttgttataatttacatatgagatagtcattgttgtatattatttataactgatcatattactgtatttgtattgttttaatagtttttctattattttgggttttcctggaatacaaccttattatctacaaattatgattgttttgccttttccaatgttcataactgtttttatattcttgtctgattgctttgttcagcacttctagaataaagtcatgcaatactaatgataaagggtactctgaacttgtgactctcataggatgc

SEQ ID NO: 465135 - DNA, 406 bp, Homo sapiens
ggcaggaaacagtggtttcctgttcatatcctgcctgagcctgggccgggtggaggtgtcctgcatggagtcttgtgaaatcgcgtggactgcaacacccagcagcgcggtgagtccaccctgaaatccacagtgacccacgcggcatgtgctgggaattgaacgcttggggaaagagctgggctccagcggatcagccccgaccaagtcgttcccacagctcaggaccggacgctacaagcccactttgtagcagtttggcggacggcaaacttttgcaacacagtgcaaaaaccatttaacacctttaagggaattggaaatgggtttttcatgtgtggtggtgctgaaaattgagaataatgacagaattattaaaaacagccttctcggccttagactctta

SEQ ID NO: 465136 - DNA, 661 bp, Homo sapiens
cttcactcttataaaccctcaggggtcgtccctgttatacccagagacacccagaagacaaaacttagccccttctccaattcctttaataaatctacttgaggcagacatctgaccatttttttttctttacagattttactggagatttgtggttttgcagggaggatcacatggcacatggcagatcacacagccttcaactatattcctttctcctttttatccccacccgtatgtaccacattgaaaataatgaattaaatcttcagaaaataatgatctcaaaggaaccatcacgaaaatgcatcatttctctcatcaaagtgttctgtgacatctgtgatgtgggctctgccatagcttatgaattgatgctcgccttccttcccccatcagaagacatacaacacgaaggaagctcatgggtagtaaactgtgagaatttggggaacagttcagcttattacttcataacccctgacactcttgctaacacgctgaagacagaaaatatagcttctggggacatcgaaatccaagacaagaaggaggcaactggcacttgttaggcttgaggcagcagtgcacagataaatgtttaatgaccagtttcccagggggaaaaaaaagaaaaagccctgatttgtagcatttgtct

SEQ ID NO: 465137 - DNA, 630 bp, Homo sapiens
agatcttcttggcttagcggctgaagactgacacagcccgatcgcctcggaagccccatagaccatcatggacgccgagcttccggtaactctcacagtggaagattttactggagatttgtggttttgcagggaggatcacatggcacatggcagatcacacagccttcaactatattcctttctcctttttatccccacccgtatgtaccacattgaaaataatgaattaaatcttcagaaaataatgatctcaaaggaaccatcacgaaaatgcatcatttctctcatcaaagtgttctgtgacatctgtgatgtgggctctgccatagcttatgaattgatgctcgccttccttcccccatcagaagacatacaacacgaaggaagctcatgggtagtaaactgtgagaatttggggaacagttcagcttattacttcataacccctgacactcttgctaacacgctgaagacagaaaatatagcttctggggacatcgaaatccaagacaagaaggaggcaactggcacttgttaggcttgaggcagcagtgcacagataaatgtttaatgaccagtttcccagggggaaaaaaaagaaaaagccctgatttgtagcatttgtct

SEQ ID NO: 465138 - DNA, 753 bp, Homo sapiens
aagaggaagttaatatatatgtttctcccaaaagtgtctttgagcacccaaaagtactagagtcttgccttcttccttgtgtgattatgaatatgttgaaaagtagtgtgtggagaagtcagtcgccaagagaaaacaggattttctggccaagttcaaagtcccgagcagatcccatgacttcctccctgcagggcagacatctgaccatttttttttctttacagattttactggagatttgtggttttgcagggaggatcacatggcacatggcagatcacacagccttcaactatattcctttctcctttttatccccacccgtatgtaccacattgaaaataatgaattaaatcttcagaaaataatgatctcaaaggaaccatcacgaaaatgcatcatttctctcatcaaagtgttctgtgacatctgtgatgtgggctctgccatagcttatgaattgatgctcgccttccttcccccatcagaagacatacaacacgaaggaagctcatgggtagtaaactgtgagaatttggggaacagttcagcttattacttcataacccctgacactcttgctaacacgctgaagacagaaaatatagcttctggggacatcgaaatccaagacaagaaggaggcaactggcacttgttaggcttgaggcagcagtgcacagataaatgtttaatgaccagtttcccagggggaaaaaaaagaaaaagccctgatttgtagcatttgtct

SEQ ID NO: 465139 - DNA, 6110 bp, Homo sapiens
  misc_feature (1024)..(1024): n is a, c, g, or t
  misc_feature (5151)..(5151): n is a, c, g, or t
gctctgccaaaaaatgagatagtgtatagaaaatgttaatagatcttggccaatgtgacccgaaagccaggtgtgcccccttggaagaaggtgtttcctcatcatagtaacctgttgagcatcatactgaggatttgcttaagaatgaagtgtagacaggccagctctggaatcccatggagtaagtgtccacactggaggtggagagtagggtggggtgaaggtgaaggctgtggattcattccttagtataatgatcatcaccagcaatgttgggaaacagtgtcctaccaaacttaggagtcaaatgacctgaatttaaatctgacttttcccacttgctgctttcttcatttctttgaatttcagttccctcttctgtaattctggagtcacagcaaacagctcgttgagttgttggcaggattatatgtgatttaaaacacaaagacttgatagagtggtggtcccgtggtgtgggctcactaaacggtaacaattgagatggtgaccagtgatcttcacaactgtgtgatttatgaggcagcgttgcaatttcgacctcagattctgtgaggcaagctgaaaaatgtaccatcactaccactttacagatgggagaacacagtcagagaggtgaagttagttgcctgaggacccacagttggtcaggagtagaggtggaattttaattccatggacccatgggcctgaacggccaaggcaaccctgggacctgacttgaaactaggaccacaagcttcccttcatgggaagctctaaggaatcatggtgctgtggacaagagccttgtctcctctcccaggaagacaaggaagaggaggccagggaaatgggcttgggctggtttgtgggaaatttaggttaagactcagaggcaacctgataatacctctgagagttcaacacatcatagcctgagcctgacctggggaagcccttgtagaatttgcagtcagatgagtacaagagcatacaaaaccccaaagaattgatttaaatnccacctatgtcctaatgacccacaaagttgtgtctccagccctaatctgactcctaaaatccactatctgctctacatctccacctggacctcacaaacatctcatgttgaacttgcttaaacagaacctcgggccaggcacagtagctcacacctataatcctagcgctttgggaggctgaggcaagaggatcacttgagcccaggagtttgagaccagcctaggcagcatagtgagacccaatttctacaaacaacaacaacaaaaccaaaaacaaaaacaaaaacacaacaacaaaaaaaacaggcatggtgtcacgtgcctatggtcccagctactcaggaggctgggaagatcacttgaggaggtattcccacctcctcaaagatcacttgagctggggaaattgaggcttcgttgagtgacagtgggaaaccctgtctcaaaaacagaaaaataagctcaacataaacataaaccagtacctcttaccatcactcccctaacgcaaaccggttctatccatgcttctcatcttggttgaaaaacttcacaatcacagttgatgcctctctttatcaattaacatccattaagttagttaggaaataattttagttctaccttgaaagtagatcctaaatctggtaaaaccttaccacctccgcagctgccaccctgatctgaagagccatcttcttacttggattaccccaacagcctcttaaaaggtctccctgcttctatcctccttacaatctattataaacacaatagtcacaatgaccctttcaaaacatgagtcaggccatatcacttctctactgagaacagtgtgatggatccccatttcattctaagtaaaaccaaataccctaaaatggcttacactgatttgtgtagatttcacataattatcctcattttacagagaaggaaactcaccaagtagcaggactgggactttaccatggggcttaaggcaccaagcccagcatgctctctaccatatcccatgatatgatgagacatttcattcttccacagcctactggagatggatagggtagggtgaaccaagttgcagaaagggatactagctttgaagagaaggaaaggctctttgaagggtggtgggatgggggtggggttttaagaagctcacatctgctcttattttagttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacaggtaaggattggggatatacctcccaaatctattgggcatgtgccaaggatgtcatgctgtctccatggagtggggggtgtcttgaacctcagatgctccttgggctcatctttgaggatctttgggaaccccttttaatgcccaacaagttatattgacctcttgacctctgaagactattgtgctgttcttcaaagccagtaattcatagcattgctctctattcttccccaagaaaacttattttttctgagactcattcctcaatgacttgcaaggtgacaatattcaccgattcataaaaaattcataaccatgaggtgtattcctaataagccctcatgtctgcacagaacttcaaagcatgcacatcatattcatatcctgtaagatgggctggggaaaacattagtagcaaatgatgttggatagaagccaactttcctgcctcctctaaggcaggtgtttacttccccatgtagtcccagggattgtccaggtgtggctttaaggttctaaggttcagtatagtgtggtggcaggagtccaaggcttttcaacctacttcaacttttctactggctttctatgtggcattgggcaactcatttccctctaaatacgcctcaatgcctacaatttgtaaaacaagaaggttctgtgtgctaatactcctgccacctgtggtactctggggttatataacccagatccattaattctgtaggagcagacaggaatcctatcagatggtacaagtcagagatggtaagacttttcttgatgctcctcaagttattagtcgtagaaagttgatactctgcctcctccagtctattgttactgtagggggaaaggtaagaagcttaatcagaataaaaccttgtttgagattcccaagattcctcaaatttgtctcaaattatgaccaagtatttcaaggtcaagtgttttcttttaccccataaagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatccatccttgtctagttccttattttaaagtcaatggctcctgcactataaaaagatatttgttgttgaatttggaatacataagttttattgcacttaaattattttctttttccttttctttctttctttctttttttttttttttgtgagacggagttttgctcttattgcccaggcgcaatctcggctcactgcaacctctgcttcccgggttcaagtgattctcctgcctcggcctcccaagtagctgggattgcgggtgcccaccatcatgcccagctaattttttgtatttttagtggagatggggttttaccatgttggccaggctggtcacaaactcctgacctcaggtgatccacccacctcagcctcagaaagtgctgggatcacaggtgggagccactgtgcctggccagttatttcctttttaagcctatttcctatccatttatagctactactgaaaatgactactgaattttatcaaataccttttaagcatacagtcacataatgatttttctcttctaatttgttggcataataaattactaaattttcttgagccatccttgcattcttaataaacttaattgcagactgctgtatcaatatattattggttctttttagctaatagtatagtttgaattttcacatctatagtcaaaagaaaaataggtctttttaaatttgttttttctatttgggtcatattactttcaaaaaatgagtatgggaactaattgggaaacctagctactttttctatgctctgaaatattttacataatatagcaattcagcattttttgaaggctaccaaaattcagctccaaaagcatctagatcaggttctttctagtggtatattttagtaatttttaaatatttcatcttatagtctgcaggttttctacctcctcttctgcaaattttggtcttttgtattttggtaaaattgatccatttttcctatattttcacatgtattactttagagtagcataaattgttctctatataattcttttatatctttaactttggttaatgctttcatttgtacattcatgtttccacccacctatttactaactattcaatccctttactcacctatccattcactcaacacatatgcaaatacccaatccccactcacctatccctcctttccttccactgacacacttttcaacttagctatttgcctactccatatgtctatccacttacttttcttactcatctttcttctacagacccacttgcccatctagcctttaattcatcttcctattattgacctctctcttccccctttctctgcacacacacacatgcacacactctttcatacccatcaaaatacatattcatcatttctatacctaactccctccatccccctaccaatgcactcntccacctttcattcaaacagcctccatcaataggcccacatatcccatcactaccctatccatctttatattcaatccaatccacttattcacccaatcatccacccatccataatccatgcattcatgtacccaaacatccatgctttcctcactaatccctctccctgctcaaccatcttcccacttatcacactctaccagccacccatccatccacatagctacctacctattcacacacctaccaatcccccccacctaccttgctcttccagcaagatgtactgagtgtttatttggggcctattcatgttttaagcactgcgttctagacacagacctgtttaatggagttcagagcttacttgggggagcaaacatgtaacttagtaatagagttagaggcagagggaacaacataggaagccagtgacagagaatcagtccatgtgacagatcttgggctaatgaaaaagcaggaggtgccaggtagaggctgatcttgttggttctcgttggagtcccctgttctaagcacaggattgttcctgggagagaattggcctggaggcagaggtagggcaccatgccctcaatgagaaaggatgaagaaaggagaggcaaaaccccaggtgggtccttacccagccttctccaagaaattattggagagaaggggccaaaaccatgatttatcccaagtcccaaagacataaattttatttcacctgcttggaaagtgagatgcttggatgggcctgaaaattaggcaagacagaatggaatgaagcaaccagaaagatagttaatttattttcaataaaatttacgaaaaaatgcagccttaattggggaccctgggtaccatttagaaatttactgactttggtgagccaagtttgcgccactgcactccagcctgggtgacagagtgagactccgtttcaaaaaaaaaa

SEQ ID NO: 465140 - DNA, 4423 bp, Homo sapiens
  misc_feature (3464)..(3464): n is a, c, g, or t
gcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacaggtaaggattggggatatacctcccaaatctattgggcatgtgccaaggatgtcatgctgtctccatggagtggggggtgtcttgaacctcagatgctccttgggctcatctttgaggatctttgggaaccccttttaatgcccaacaagttatattgacctcttgacctctgaagactattgtgctgttcttcaaagccagtaattcatagcattgctctctattcttccccaagaaaacttattttttctgagactcattcctcaatgacttgcaaggtgacaatattcaccgattcataaaaaattcataaccatgaggtgtattcctaataagccctcatgtctgcacagaacttcaaagcatgcacatcatattcatatcctgtaagatgggctggggaaaacattagtagcaaatgatgttggatagaagccaactttcctgcctcctctaaggcaggtgtttacttccccatgtagtcccagggattgtccaggtgtggctttaaggttctaaggttcagtatagtgtggtggcaggagtccaaggcttttcaacctacttcaacttttctactggctttctatgtggcattgggcaactcatttccctctaaatacgcctcaatgcctacaatttgtaaaacaagaaggttctgtgtgctaatactcctgccacctgtggtactctggggttatataacccagatccattaattctgtaggagcagacaggaatcctatcagatggtacaagtcagagatggtaagacttttcttgatgctcctcaagttattagtcgtagaaagttgatactctgcctcctccagtctattgttactgtagggggaaaggtaagaagcttaatcagaataaaaccttgtttgagattcccaagattcctcaaatttgtctcaaattatgaccaagtatttcaaggtcaagtgttttcttttaccccataaagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatccatccttgtctagttccttattttaaagtcaatggctcctgcactataaaaagatatttgttgttgaatttggaatacataagttttattgcacttaaattattttctttttccttttctttctttctttctttttttttttttttgtgagacggagttttgctcttattgcccaggcgcaatctcggctcactgcaacctctgcttcccgggttcaagtgattctcctgcctcggcctcccaagtagctgggattgcgggtgcccaccatcatgcccagctaattttttgtatttttagtggagatggggttttaccatgttggccaggctggtcacaaactcctgacctcaggtgatccacccacctcagcctcagaaagtgctgggatcacaggtgggagccactgtgcctggccagttatttcctttttaagcctatttcctatccatttatagctactactgaaaatgactactgaattttatcaaataccttttaagcatacagtcacataatgatttttctcttctaatttgttggcataataaattactaaattttcttgagccatccttgcattcttaataaacttaattgcagactgctgtatcaatatattattggttctttttagctaatagtatagtttgaattttcacatctatagtcaaaagaaaaataggtctttttaaatttgttttttctatttgggtcatattactttcaaaaaatgagtatgggaactaattgggaaacctagctactttttctatgctctgaaatattttacataatatagcaattcagcattttttgaaggctaccaaaattcagctccaaaagcatctagatcaggttctttctagtggtatattttagtaatttttaaatatttcatcttatagtctgcaggttttctacctcctcttctgcaaattttggtcttttgtattttggtaaaattgatccatttttcctatattttcacatgtattactttagagtagcataaattgttctctatataattcttttatatctttaactttggttaatgctttcatttgtacattcatgtttccacccacctatttactaactattcaatccctttactcacctatccattcactcaacacatatgcaaatacccaatccccactcacctatccctcctttccttccactgacacacttttcaacttagctatttgcctactccatatgtctatccacttacttttcttactcatctttcttctacagacccacttgcccatctagcctttaattcatcttcctattattgacctctctcttccccctttctctgcacacacacacatgcacacactctttcatacccatcaaaatacatattcatcatttctatacctaactccctccatccccctaccaatgcactcntccacctttcattcaaacagcctccatcaataggcccacatatcccatcactaccctatccatctttatattcaatccaatccacttattcacccaatcatccacccatccataatccatgcattcatgtacccaaacatccatgctttcctcactaatccctctccctgctcaaccatcttcccacttatcacactctaccagccacccatccatccacatagctacctacctattcacacacctaccaatcccccccacctaccttgctcttccagcaagatgtactgagtgtttatttggggcctattcatgttttaagcactgcgttctagacacagacctgtttaatggagttcagagcttacttgggggagcaaacatgtaacttagtaatagagttagaggcagagggaacaacataggaagccagtgacagagaatcagtccatgtgacagatcttgggctaatgaaaaagcaggaggtgccaggtagaggctgatcttgttggttctcgttggagtcccctgttctaagcacaggattgttcctgggagagaattggcctggaggcagaggtagggcaccatgccctcaatgagaaaggatgaagaaaggagaggcaaaaccccaggtgggtccttacccagccttctccaagaaattattggagagaaggggccaaaaccatgatttatcccaagtcccaaagacataaattttatttcacctgcttggaaagtgagatgcttggatgggcctgaaaattaggcaagacagaatggaatgaagcaaccagaaagatagttaatttattttcaataaaatttacgaaaaaatgcagccttaattggggaccctgggtaccatttagaaatttactgactttggtgagccaagtttgcgccactgcactccagcctgggtgacagagtgagactccgtttcaaaaaaaaaa

SEQ ID NO: 465141 - DNA, 983 bp, Homo sapiens
tctcttctcatccatacaggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatcca

SEQ ID NO: 465142 - DNA, 1029 bp, Homo sapiens
  misc_feature (26)..(27): n is a, c, g, or t
aggggctcgagcggccgccgccagtnnctaggcgctcgagcgaccgctggggcaggtaaagcagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatcca

SEQ ID NO: 465143 - DNA, 1330 bp, Homo sapiens
gcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaataacggagttttgctcttattgcccaggcgcaatctcggctcactgcaacctctgcttcccgggttcaagtgattctcctgcctcggcctcccaagtagctgggattgcgggtgcccaccatcatgcccagctaattttttgtatttttagtggagatggggttttaccatgttggccaggctggtcacaaactcctgacctcaggtgatccacccacctcagcctcagaaagtgctgggatcacaggtgggagccactgtgcctggccagttatttcctttttaagcctatttcctatccatttatagctactactgaaaatgactactgaattttatcaaataccttttaagcatacagtcacataatgatttttctcttctaatttgttggcataataaattactaaattttcttgagccatccttgcattcttaataaacttaattgcagactgctgtatcaaactttagagcacaatggatctcgagcaaggagaggacagcgattctcgtacgaacggttac

SEQ ID NO: 465144 - DNA, 1126 bp, Homo sapiens
gcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatccaactttagagcacaatggatctcgagcaaggagaggacagcgattctcgtacgaacggttac

SEQ ID NO: 465145 - DNA, 2035 bp, Homo sapiens
gcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacaggtaaggattggggatatacctcccaaatctattgggcatgtgccaaggatgtcatgctgtctccatggagtggggggtgtcttgaacctcagatgctccttgggctcatctttgaggatctttgggaaccccttttaatgcccaacaagttatattgacctcttgacctctgaagactattgtgctgttcttcaaagccagtaattcatagcattgctctctattcttccccaagaaaacttattttttctgagactcattcctcaatgacttgcaaggtgacaatattcaccgattcataaaaaattcataaccatgaggtgtattcctaataagccctcatgtctgcacagaacttcaaagcatgcacatcatattcatatcctgtaagatgggctggggaaaacattagtagcaaatgatgttggatagaagccaactttcctgcctcctctaaggcaggtgtttacttccccatgtagtcccagggattgtccaggtgtggctttaaggttctaaggttcagtatagtgtggtggcaggagtccaaggcttttcaacctacttcaacttttctactggctttctatgtggcattgggcaactcatttccctctaaatacgcctcaatgcctacaatttgtaaaacaagaaggttctgtgtgctaatactcctgccacctgtggtactctggggttatataacccagatccattaattctgtaggagcagacaggaatcctatcagatggtacaagtcagagatggtaagacttttcttgatgctcctcaagttattagtcgtagaaagttgatactctgcctcctccagtctattgttactgtagggggaaaggtaagaagcttaatcagaataaaaccttgtttgagattcccaagattcctcaaatttgtctcaaattatgaccaagtatttcaaggtcaagtgttttcttttaccccataaagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatcca

SEQ ID NO: 465146 - DNA, 1065 bp, Homo sapiens
gcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatcca

SEQ ID NO: 465147 - DNA, 1032 bp, Homo sapiens
tctccttgctcgagatccattgtgctctaaaagatgcaacctgatatggctgttggagcccaagtagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatcca

SEQ ID NO: 465148 - DNA, 1740 bp, Homo sapiens
gcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatccatccttgtctagttccttattttaaagtcaatggctcctgcactataaaaagatatttgttgttgaatttggaatacataagttttattgcacttaaattattttctttttccttttctttctttctttctttttttttttttttgtgagacggagttttgctcttattgcccaggcgcaatctcggctcactgcaacctctgcttcccgggttcaagtgattctcctgcctcggcctcccaagtagctgggattgcgggtgcccaccatcatgcccagctaattttttgtatttttagtggagatggggttttaccatgttggccaggctggtcacaaactcctgacctcaggtgatccacccacctcagcctcagaaagtgctgggatcacaggtgggagccactgtgcctggccagttatttcctttttaagcctatttcctatccatttatagctactactgaaaatgactactgaattttatcaaataccttttaagcatacagtcacataatgatttttctcttctaatttgttggcataataaattactaaattttcttgagccatccttgcattcttaataaacttaattgcagactgctgtatcaaactttagagcacaatggatctcgagcaaggagaggacagcgattctcgtacgaacggttac

SEQ ID NO: 465149 - DNA, 1611 bp, Homo sapiens
gcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatccatccttgtctagttccttattttaaagtcaatggctcctgcactataaaaagatatttgttgttgaatttggaatacataagttttattgcacttaaattattttctttttccttttctttctttctttctttttttttttttttgtgagacggagttttgctcttattgcccaggcgcaatctcgcctggatgacagagcaagaatgtttttaaagaaaagaaaggaaaggaaaggagaagagaagagaagaggaaaggaaaggaaaggaaaggaaaagagaagaaaagaaaagaagaaaaaagaaaagaaaaatttgattcggtagtctcttcaagtgagattgtcaagttggtggcatgggattcttacggcggctgtctgtgatcctaaattttgtgaccatatagtcactctctgataataaggctgtctttgtctggcctctgtctgtcatgtaggaaaatttggagaacaaacttggcccaaaagggtaactcctagttagagaagaaaacgggagccctcgggataacatttactctgt

SEQ ID NO: 465150 - DNA, 1144 bp, Homo sapiens
ataagaactgggggagaactcagttgctggcagaaagggctgctggagctccctgaccaggttcttagaatgtgcacacctgtggactgtggaagacctgctccaggaaagcagctccggacaaactggaggaacttcagggattccttcggccttcagagcattgacttctctcctcctttttcacttttctccaaccttactgtcttttttgctgttcctcagacacagcagcttgatcccactaccaccaaggaactaaatgctttactatatcctttaaacaatgttgcacatttagatggtgtcctgaaaattttatatcctttaaacaatcttgcacatttagatggtgtcctgaaaattttatgtacttttgagagcccagaggatgttccaaagaggtttcaagtattctgtgtacttggcctaagttttaaaattgaaattgaaaaaaataactttaaaccaactaattatctcttctttaagtaattgtttgaatgccctcatggcctggcagcctagcttccacaagaacaaacagtccaagatgccaaggcagaagctgaaattccttttataacctagccccaaaagttacctttgtcacgtctactgtactctattggttatgcatgttctgttggaggaaggagactatggaacggcatgaatatcaaaaggccatgatcactggagccatcttggaggctggctatcacaacactcacctcactgctatcagagtgatcccttaaacatgaacctgtctaattaaagtggaaatggtgaagatacactgtggatagaggaattgagaagaatggtggtgaaggcctgaaagagaatggaagataaagcagcaatttactatgggcatcaaacagatacgtcgaatgacattgagggtttcactgaagaccagtggactcaaacttacccaatatggccactgttctctcaaaaaacgtgagcaaatgacatctggagctgatctccaatattttagagaaagaattgaaaagaatttttgtgggggaataaaattttacccagaaagtaaaatagatgacctctttttatgagactctagtgttcttaacaagctgtctaataaactatttcctatttaaaagaataa

SEQ ID NO: 465151 - DNA, 1985 bp, Homo sapiens
actcaacactcaattaggatgtggctgctgggggccagcaccatgcagcagcgtcccatccagccctctttcaccaagtccctctgccgtgagtcccactggaagtgcctcctgctctcgctgctcatgtacggctgcctgggggcagtggcctggtgccacgtcaccacagtgacgcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtctaccacgaacgcgtcaacacgcacgtggcggaggctgagttcgactacgcgcgctgcggcgttcgcgacgtgtccaagacgctggtggggctggagggcgcgccggccacgcggctgcgcttcaccaagtgcttcagtttcgccagcgtggaggccgagaacgcgtacctgtgccagcgcgcgcgcttcttcgcagagaacgagggcctagacgactacatggaggcacgcgagggcatgcacctcaagaacgtggacttccgtgagttcatggtggccttcccggacccggcccggccgccctggtacgcctgctcgtcggccttctgggccgcggcgctgctcacgctgtcgtggccgctgcgagtgctggccgagtaccgcacggcctacgcgcactaccacgtggagaagctatttggcctggagggcccgggctcggccagcagcgcaggcggtggcctcagccccagcgatgagctgctgcccccgctcacccaccgcctgccgcgggtcaacacagtagacagcacggagctcgagtggcacatccgctccaaccagcagctggtgcccagctactctgaggcggtgctcatggacctggcggggctcgggacgcgctgcggcggggcaggcggcggctacgcgccctcgtgccgctacggtggggtaggcggcccgggcgcggcgggcgtggctccctaccggcgcagctgcgagcactgccagcgcgccgtcagcagctcgtctatcttctcgcgcagcgccctaagcatctgcgccagcccgcgggccggcccggggcccggtgggggcgcgggctgcgggggcagccgcttctcgctgggccgtctctacggctcccggcgcagctgcctgtggcgcagccgcagcgggagcgtcaacgaggccagctgccccacggagcagacgcggctgtccagccaggccagcatgggggacgacgaggacgacgacgaggaggaggccgggccgccgccgccctaccacgacgccctctactttccggtcctcatcgtccaccggcaggaggggtgtctgggccacagccaccggccgctgcaccgccacggctcctgcgtagagacctcactgtgacctccggccccggagtggcccgcgccgtcctcccgcctgcccctcgccggactgtgctccctctgcgacgcagggcgagtcaccacggtgactgaggccgcgcggggggcagggaaagggaggagctgcttcccaccgtcctgggagaagggtgcaaaggaaggggtcatttacatcactacccaggatctgacacacatactacacattttcaggtagatgtgactaaaacaaaagtttcacaaaacaatacttaacctatttgtgacgcatgatgacatattctgttcttttccatttgaaaaatggtagccaatacccactaaattgacatctcaaccctactagtttgaaaaacatgaatctctggc

SEQ ID NO: 465152 - DNA, 821 bp, Homo sapiens
tcttggttgtgagggtcataagatgggaactctcccggcacgtagacatatcccgccgtgggtgaaagttcccgaagacctgaaagatccagaggtgttccaggtccagacgcggctgctgaaagccattttcggtgagtgtgcccagtactggcgggctgccccggctcgggagtctcagccggcccggggatctcatctcttttccccaacaggcccggacggatctcgaatcccttacatcgagcaggtgagcaaggccatgctcgagctgaaggctctggagtcttcagacctcaccgaggtcgtggtttacggctcctatttgtacaagctccggaccaagtggatgctccagtccatggctgagtggcaccgccagcgccaggagcgagggatgctcaaacttgccgaagccatgaatgccctcgaactaggcccttggatgaagtgaaccagtttccagccaatgcaatgaagccgggttgcagagattaggttgtggccagagctagagtgattccttaagcttgttttaaaatctgctccagcctaaagagttaagggaaaaccatttgttcccttaaagagttaagggaaaacccttggctctgagtcttgttgtgaatatttctttgatgattgttaataaaaagtgttttttcttttttcccatttttaaaaataacaataaagttttaaataagttgatagttcagtgtggttgatggattgtaggaagaagtatatatacttctctctccatttgttacataaccaagcttcatatcacagaagtgtatgtcttctcctctgccata

SEQ ID NO: 465153 - DNA, 4054 bp, Homo sapiens
gtgtatcgggctgaagacctgccaggttggacgtccctgccgtgagtggtgtcctcagaggccgcggttctctgcagcagccctgggcagtctgcagcagggaaacctctggtcgagtgggtccagggggagccttggtggccaagtctgctgtgtggccgcagtagaatcctgagcctgggtgagggggaagagcagaagtttccttcccacatttctggaggctgggggtgcaagatcaaggcgccggcgtccccggggcctcctggctgtgttcttggaggctagagggcgctggaggccgcaggaagcctcttgtgtgacggccttgatccccttcactgggaggagacctggagctagtcatcctccaacactatcacgtcggcaacgcctgggtcttggaggggacacattcgaacctcagccaggtacaagcaggagcagggaggccctgacggggcaggacggtgacacctcctctccacacctctgcagcagaagatcgtgcctcctggtggggatgattattgattaaagcatctgaattcaatcagaagctgtttcctgagctcatcaggaaaggctgctctgacatggaaccagtaagctcttccctctacctgccgggtgattcacacgggctctgaaccaacacacacagagagggcagtgtggagatggagccgggaggtgcagctgcagccaggggaggcctagagccccgcagagcatcaggaggctggaaggagccttcctggaccttcagggaagctcgccctgcctgcacctggaaccgagatcacaggtctctagctgcagttctgtgcgccctgcctgcacctggagccgagatcatgggtctctggctgctgttctgtgagcgggtagatctgctggttaaggccaccagtcagtgccatttgtctcggcgtccatgggagagaaacacagtccctttctccttcctggagccccctcccctgtccttggcttatgtcctctggcacgtcctgagctgtggccacagcgagcctcaggctccaggcctttctgcccagcttctgctatggcctagcatggtggaccctccctcacgtcccatccctgactcccctcatccacccaactgtccccgctcagccgctgcgaccgctcccaggagaacgctctgttcattgctcggcactgagggttgttttatataaatatcactcgcgacagtggatgcctcttcagggtggaacccacgtggcagctggtgtgtccctgtgggcaacttgctcatgactttgcaccatcactggaggtttaacaaaaatctcatttattcaattccaggctggaggtagcctgcatcatttcttcatctggtaggtagttttcttttttttttttttttaattcgggatttaaaccctttctaggaaacagacatctctagagaaaaatgaaagcataaatctacctctataagcttgaacaaataaattacagtaaagcactgttaactcaaactaacttgaaggaaacgctgcttattagcaggaaagatcatttaaagtaaaatacacatggtaccacctttgatcactgtggattctggagcaatgttcatattccatgcaaggatgccaagggccaggttccaacgtgggattgtttctcccgccccatgagggtccattgccaaggagggacacacgcaggaaaatgggaatttaaaggattgctgactgtgtctcccaatgccccaacgaaggactccagaaaagtgagcaggggccgggcatagagcccaggcgagggtcccaggctaggcctcgctcccagctccttggaacctcagccctgctggctccagaggccaagactctgtgatacaggagttattaagaaataatttttaggcagatagtaaaggtaaaggttcttggtgtaaactttcctgtaataaaaaacacccgaaccatctcttttctaacagaaaaggcggcttgaagggccggactggcaagctttgatatgcaaatgccgaccattagaaactggatacctcaatatggcaattcccgctgtcttctccttgccagcacgtgtaccaagttcatggccacctccagataacaccaagtgttgggaacatcatggtgacccacatttgcatattaaagggctaaggtgggagggccaggtttttctcaggctatgtaaatgacacacctggtcaagccaatcccctcggccttatgcaaaccagacaccgcctcctccagcgtcccagtataagcagccacttttccgccccacacgggggttttctctttgtttgaatccccctccctctgctctgtacaggggagctgctttcttcttccttccttctttcttgcctattaaactttttgcactgggcctgacacccctgccactggccaggggctgaaggggcctggacccaagtgaccagtaaacagcctcgatctctctctgtctctctgcatctctgtctctgtctctctctcgtccaaatcttcagaggcagcctggcctcctggggatggtgggctaggcctgtgaggttggggggatccaatcactaagcggaaggtgcagagcccagcccaccctgcctccctggccccactgctctcggaggcatggaacacactgcctcacttcctcaccacggccagtggagacggggcaggggtctggcatttgaaagggccgtcctgttcagccctgcccctggagaaccagcctcgggtgtgcctgtgacggctccatggaacaggccactatagattccgccgtgacagtcaggatgttggagggcccctgccaccatagggcctgacttggggcagccagacctgagtgggagcagggatggcctggtgggagaggcctcggctcaccactcactggctctgcaactcttactaaaccagcactgacagccacagcctcaaatccctctggtgcaagcttggagttcgcgttcatccttccgtgttttccgggggctgagcacgtttcttcccggcctcctgctccccacagagatgaggctgtgcttgggtcacagcttccccttctggaggttacattctgctccatcttcagtgtctgtgatatgggcgtgtgtctgttatgtgtgtggctgtgtgtccctgtgtgtttgtgtgctgcatatttgtgtgtatatgtgtgttgtgttttgtgtgtgtggtatttctgtgcatttgtgtgtctgtacgctctgtgtgtatctgtgcatgtgtgtgtctgtgcatgtgtctccatattcctgtgtgtgtgcatgtctgtatgctccctgtatgcatgtgtgtgtgtatgctctatgtgtctgtgtacatgtgtatatgctatgtgtgtgtgcatatgtctgtacactctgtgtgtgtctgtgcacgtgtgtctgtatactatgtgtgtgtgcatgtgtatgtgcatgagtgtgtctgtgcctgtgtctgtacactctgtgcatgtatgtgcatgtgtgtgtctgtgcatgtgtgtatactctgtgtctgtgcacatgtgtgtctgtatgctatgtgtgtgcatgtgtgtctgtgcatgtgtgtctgtacactctgtgtgtgtttgtgcaggttgcatgtgtgcatgcgagaccttgctttgtttgccacatgtggcagctccctaggaaggcgcctctgcagggtcctgctgctcaagccttcccgctgagctgccttcatgctgccctgacccacagttgaaagctgagctctgcagcccgtgccaggagctcttcttgctgtgtttttgctgcaggaagcagcaaaatgggtgctgggtggaaactggagccaggcccctccacgtgctgctctcgggcccctggagatgaccaggccagtgagggtggggccctaaaaaacctgtggccatgggagggtgtgcccgagcctggggtctcctcctcacgggggccctggccaccagctgggtgtgcacttgcagccccaaacatgccccgcggatcccaccctccagc

SEQ ID NO: 465154 - DNA, 3281 bp, Homo sapiens
gcgttccccagctccccccgcagcccgctccacagtggtccgctccggttggttgtcacagcagcctcgacgctatggaggagcctggtgctacccctcagccctacctggggctggtcctggaggagctaggcagagttgtggcagcactacctgagagtatgagaccagatgagaatccttatggttttccatcggaactggtggtatgtgcagctgttattggattttttgttgttctcctttttttgtggagaagttttagatcggttaggagtcggctttatgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgagcaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggacaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattaaaagtgaacagtcaatgggaaaatggtgctaacttagatgatcctccgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagatcagccatgccactgaagagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaagagagttgaaatttgaacttttagaaaaagatcctaatgcactcgatgtttcaaatacagcatttggcagagagcattccccatgtagtccctcaccattgggtcggccttcatctgaaacgagagcttttccctctcctcaaactttgttggaggatccactcagactctcacctgtgcttccagggggaggaggaagaggcccaagcagcccagggaatcccctggaccatcagattaccaatgaaagaggagaaccaagctatgacaggttaatcgatcctcacagggctccttctgacactgggtccctgtcatctccggtggaacaggaccgtaggatgatgtttcctccaccagggcaatcatatcctgattcaactcttcctccacaaagggaagacagattttattctaattctgaaagactgtctggaccagcagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggccttattcctccacctcttgctccaatcagcggtccattgtttccagtggatacaaggggcccattcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagacacctgacaatattgttgctttcttcaaaagtaattttgactgatctcattttcagtttaagtaactgctgttacttaagtgattgcacttttctcaaattgaagtttaatggaataatagttctcaggatagtattttgtaaataaagatggtttgaatatgaatcttatgagtaaatcatttccattttattatattctagatcatataacttttaacttggtgaactaatccactcttagagaaacaatagtgggagttttatatatgtaatcttgcaggtgaggaggctttaaattctaaaggttgtggtgtcttcatgccaagaactgtattcactgtggttgtagataaatgtgaaagtaactttatgcttaatttaataaattttcattgatttttttaaaaaaagaaaactgaaaggagatatagatgaatccacaattatagttagaaatttcctcatgcctttttcaataattgatagaactagacagaaaatcagcaaggagtgttggctttggcagcactttctaaaatcagaatgatgccaacaagattaaaacggttcttgaatatagattacacaaaattttgtgaagcatttcatgtttttaaaaagaggaaaaaaaagaaaatcaacaagaatataaaacaactcaaaatgccattaaccaaaagaatctatttggcatttacagaatattccacacagtaacagcagaatacacatattttttttgagtgctgacgaaacacctggcaagatagagctgtcctaggccctaaaactc

SEQ ID NO: 465155 - DNA, 1893 bp, Homo sapiens
  misc_feature (1891)..(1891): n is a, c, g, or t
ggagtgttgacattcagggatgtggctgtagaattctccccagaagagtgggaatgcctggactctgctcagcagcgtttgtatagggatgtgatgttggagaactacagaaatctggtctccttgggtcttgctatctttaagccagacttgatgacctgtctggagcaaagaaaagagccctggaatgtgaagagacaggaggcagtagccaaacacccagattattaagaattttgttaaacggatgcttgaaggcagcatactcgttaagagtcatcaccactccctaatctcaagtacccagggacacaaacactgcggaaggccacagggtcctctgcctaggaaaaccagaggcccttgttcacttgtttatctgctgaccttccctccactattgtcctatgaccctgccaaatccccctctgcgagaaatacccaagaatgatcaataaatactaaaaaaaaaaaacgagatttttgtcatacattagaataggtatgaatgatttagcagataacatatgtgaaatgtccaaaggtgaaggagaaaacaagagcttaaaatgtggattgggaagctgttctccaatggaattgattcttgaaaagcctcttactgtcatggaagaaaattttttggtattgccagagcatgacataaaagattcatttcaaaaggtgattcttagaaaatatggaagcagtgaccttaatactttacatttaaagaaagactaccaaagtgtgggtaattgcaaggggcagaaaagcagatacaatggccttcatcaatgtttgtcaactacccgtagcaaaaccagtcaatgtaataaatgtggtaaagcttttgggttgtgctcaatcttcactgaacataaggaaatttttagcaaagagaaatgctacaaatgtgaggaatgtggcaaagactgtaggttgttctcagattttactctacagaagagaatccatactgcagagagatgctacaaatgtgaagattgtgccaaagtttttaaaaagttctcaaaccttactgaacataatagagttcatcctggagagaaaccctacaaatgtgaagaatgtggcaaaacctttacctgttcctcaacccttattaaacacaagagaaatcattctggagacagacccggcaaatgtgaagaatgtaacaaagcgtacaggtggttctcacaccttgctaaacataagagaattcatactggagagaaatcctacaaatgtaatgaatgtggaaaagcttttacatggatctcggtccttagtcatcataagaaaattcatactagagagaaaccctacatctgtgaaggatgtggcaaagcctttacccgctcctcaaccctgattagccacaagagaattcatatggaagagagaccctacaaatgtgaagaatgtaacaaagcctacaagtgtcaacataagagaattcatactggagagaaaccctacaaatgtaatgaatgtggaaaggcttttacgtgtatcttggcccttagtcaacataaaataattcatgttggagagaaaccctacatctgtgaagaatgtggcaaagcctttacccgctcctcaacccttactaaccacaagagaattcatatggaagagaggccttacaaatgtgaagaatgcagcaaaacatttaagtgcttctcagacctcactaattataagagaattcacactggagagaaaccctacaaatgagaagaatgtggaaaagcatcgagctcacataatatatacttttctattcatctaatttcataaaacattctttgtataatcccctcagagattatgacagtgactgacaaaatttaatggtgttcacagaataattttcacatgtganaa

SEQ ID NO: 465156 - DNA, 1196 bp, Homo sapiens
cccaaaattatgtaacttctccacaggataagatccgatcctacagtaaatagaaaggtgccacttattcatctgaagaagcaaaaggaaatgctttcaacccagatcccagacacagagaggagcccaggtttaaaagctcctccctgccaaggacagagtgccactcaactccatctttgcccataagtctccctgggggacgtctggcaatagctagagacatttggggatgtcaaaactaggaaggacgctactgcatcagtctacattggtctttaactatgacatgtacaaaccagtgggaaaacattaactatggttaatggactgaatggatttatttaagaagaaatatttaaagaaccaaaagcatcaaattatctccacaacacatatattagtcacagagacataatgtaaagtatgtcctaaatattacgtcttccaaaaaccccatcttaagcctcataaagattgaaagaaacagcacatttcgaaatctcaaattctcttagccatatttttacttttctcttctcatcacctatttcaatatttttctacctttctaattaaggtctatactctagagggaagactgtgggtatggtagagcaaagactttttcagttgcagagtgtgcatatgaaaccagagacagagttgcactctattgcccaggctagacatgaactcctgggctcaatcgacactctcccttcagcctccactgctcctggctcaaaattcattttaatatgtgaacttgtttgtcaggccctatcttattttcagcctctacagttccctttcccacagcgagagtcactttatactgtctctggaccaatcactgaccatccaaaatcagtcaagatcttaaaagtaagccaggcaacgatcctgagtgtcagttctcttgagacaggaacacagccactgcaaggtgtagaaagtacccactaccaagggttgaataatcacagttccatactcaattctacctgcggaaggttttgtaacttgagctgagtgacttctcattctagtactatcttctttaaaatgatgaggtggcactcatcatttgaaagtactgtcttttaaagtacttttaaagtactgtcttttaaagtacttttaaagtactgtcttttaaagtacttttaaagtactgtctttaaaatgattgc

SEQ ID NO: 465157 - DNA, 461 bp, Homo sapiens
cccaaaattatgtaacttctccacaggataagatccgatcctacagtaaatagaaaggtgccacttattcatctgaagaagcaaaaggaaatgctttcaacccagatcccagacacagagaggagcccaggtttaaaagctcctccctgccaaggacagagtgccactcaactccatctttgcccataagtctccctgggggacgtctggcaatagctagagacatttggggatgtcaaaactaggaaggacgctactgcatcaggaaaagaagcaagggaagagtgaaaacactggcttggaatgagctctgatcatgtctactctctcctactcctactttttcttggagctacaaagataaattgtttgagtctttaggagagcctaactccttattcaagtatttccttgctcctggatgtggaaaaattgcttaaataaaaactactcaaaagaaa

SEQ ID NO: 465158 - DNA, 1004 bp, Homo sapiens
atttttttttccaaattactgactgccttctttcaaggggaaatggaactcagaaagatgggaagatacatgataagagcacttaagagagaagcctgtccatttccactaaggttgaagtgtgcatactccaggatccagtccttcatgtctacacaaggagtcccaggaaaaggtctgtgcaaaacgtttgtaattgcaacggagcagccacgacctagccctccttcagcagaggaatgaataaactggtttattcagtcaacgcagcagttaaaatgagagaattagtgatgttgaaaggaaaaatgaagagcaaacagatacagtaggaagttatcacgtacatttcaaaaacattcaaaacaaccgtacatatttatggattcatgtaataatgcagtaaaaatacaaaatcagagccaggactgtggcacactgaattcagcacaatggtcgtctctaaatgtgggttcatcagcctcttggcaaatcgggagctctttgtgaggtgtgattaccaaaacccgctggaagggtatcagcaccacctcacaatgaacccagtgttgctaattctgacgccaatatttccacaggactcagttgatggaatcttcctgaatgtgttatttatggttcaggtcaacatgagggtgaccatcgccagggtcagtgcatttggtaggagaccagggaccgtttctgggaatgtcaggaatcttgtctttcaaatgctcacttcacttcacagcccctgcgagtgccctgaacctttgcaagatgtcggggtgacaggagccgcagagccggagcaaacggctgagataagagcggacagcgtgagagaagctgcccatgaaagcgctggtgtgaaaaagctgttaatgaaagcggctgctgaataaaaccatattcacctgcctagagctccccaagcgttctttccgctcatccacccactcccctcggaccgcagcatgggctggacctggaccccagga

SEQ ID NO: 465159 - DNA, 977 bp, Homo sapiens
gactgtgccagactctagggcatactgggagggcatgtacatattcagttttaggggctgccagatacttctggaaattaataagaaaaagactgaaaaccctatagaaaaatcagtaaaagagttgaacggtcacatcgcgaaagaagatgctcagccatactactgcatctccatcagtggctataaagaaggacaagttgaaaaggacatggagcaaccagaagttctgtatgctgatggtgggagtggaaatcagtgcaaccactttggaaaactggcaatatcttctttgaggtatgacaaaatgctgctgctgcagctgatggcaggaaatcatgatggaacacctattttgtgtcagacgctgtggaaagcaattcacaaagtcatcttctatggcctgaacgtgatctccccaaatttatattttgaatcctaatctctaatgtaattgggattagtgactttattttaaaaaggccctggagagactcttcagcccttctaccacttgagagcatagcaagaagacagccgtctaggaaccaggaagccggacctcactagacattgaatgtgtggcatctgagtcttggacttccagcccccacaactgtgagaaatgcatattttattttattttgttttgttttattattattattttttgagacggggactctgtctgtcactcagcctggagtgcagtgacacaatcatagttcactgcagcctcaacctctcaggctcaagcggtcctcccttttcggcctcccaaaattctgggattataggcgtaagtcaccatgttcatccaagaaataaattttgtgttgtttatttggactaagatatcatcttattttatcctatgaaggatctgttgtaagcttcagttaagtgactggcctggccgatggagaccaaacctggccatgggacttgggagatgtaaccatcagcatcacttgccc

SEQ ID NO: 465160 - DNA, 2679 bp, Homo sapiens
atactgagtgtgcaggcaccttctgggccactctgagagctagtgacacagggaccctatgcctggggctccgcatggtgcaggcagccaccccgggggcctcagggctcccctgcagccccagacaggccttggctttgtaccagtatctcttctggtgccccgcaagcccaggccagctcagggctgcactttggcaggtgcaagagggccgcgggtatcccccagggctggagctgccccctgtactgctgcagatggagtggagccggcgggcccaggagcagctcctgtgggacttggaactgctgactggtgtggagctgggcctcttctggccaccccaggcccagtttttcggtccgaggggccaggcccagcaagcatggagccagtgctgtcagccaggtggtagcacaggtggggaccctgagcagccgccccagatctgggtgaaaccgggagtggtgcagaccaagggtgggagagccctggaggacctgcagagcccacacgcggacctggcccagagggaagagaggagtgaggcagagcctgagacccagaaaagaaagctcactcccgggacccctgggccgggggacctgccctcccaaaacctgccttcccaagatgcccttgaagggctgggctcggacccgcacctgggccaggagagagcagaacttcaaagaccaccaaggatggacacccctgagtctgagaggaggaccctcaggatcagaaagcggagacccctcagcgtaagagagccgaggcctcctggggcgagatcaaagatgctcctcagagtcagaaggtgaagacacacgggggccagagcccaagggctcctcagggtcagagggaggagtcgaagagaatttagtcctaagtgccagggaaaggcgagtccccagagtccagggaagaagatgctgcggtcttgggaaggcaatatctcacaagcctgggaggtggctcccggagaggccactgtgcagcccccagaggaaggcgacccccatagccatccgagggactcctgcgggtccctgaaagcacagactccaaagcctgtgggcagggagagcccaaacctccggagaaggactaccacgctgacgcagagcatgatcaaaggcgagccacaaaggtcggcaccggcggtggcaaagctgggggccgcccgggagggggcgtgggctgcgcttacccgcccgaagcccccggcccggcggcggctcccaggtcgcggagccggagccgagatgccagcgaccctgcgcgccgaggtatccgggcagcaggggctcctcggggctctccggggcccccaggcctggagcgcgatccgcacgggctgcagggccctggagtgggccccgcaccgggggagcaggaggtgggccaggcttggcttccgggtgccctccggggtcgggtggggcggccctgagcgtcccaaggccttgaaggccgcgtggccggcgcccctcagcaccgccaaggcgcctgcgggcttaagcgcggcgcagcaggtgacggctctgcagcggctgctggagctgcacagcgcggccaggcggcagcgccgccggcgggaccgtgagcagcagcggctccgggtgtgtccccacgccgggatcggggcctgcctggagcgggcggggcaccgaggggcggccggacgctgactgccgcctctgcaggtcctggaacgcctccacatcgccaggaaccgccactgccgggttcaccccgtggggctcccgcccagtccggctcaactcccgccacaggcaagacccctagaaggcggtggggccacaaggagcctgcgcggggcaggggccgagcttagcgcgcccgggtccctttgaagtgagcgcactgcactctggcagtgactcggcggggcgcgaggggcaggtgtgccaggtgctgccccgcccgccccactgagccgcggacgctcagcgctccgcaccgccaggaggacgcggctgggcggcggcgcgccctgcgggagcagctggagcaaatgcatcgggagaggacggagcggctgcgggccctcggggccaggaacacccagaacttcctggaactactgtgttcccctggtgctgaggatcccgtgcctgcgaagtagtgctcgcccttcccagcaccctctggtcattgctgagtcctcaaagggatgattaaagtgatgagggttacggaaaaagcaagagggcaacttgcagcccacacctggcccacggtcagagggccaggtctcggggatcaagcagtgcgaaggccccgttcttgcggaagaatgactcaatgcggcacatcttgcaggagaccagttcttgcttcactggggggcctgggaaaagatgaatccgtcagtggagtagccactttgtgggaagaaatagaaagtgctttggaggaatgggagctatgggcaaatactgggagctggctggatgccaggatacagcagccatctgccatcattaccctagcttcaggatcctctacctgcagggaggggggccaccctagcctgcttgtcacagggacagactgtggagagatgagatttccttcggcctcctgctccccgcttctagggctcgcctcctgcttttgttagaaagttatttccctgacttccccttt

SEQ ID NO: 465161 - DNA, 2485 bp, Homo sapiens
atactgagtgtgcaggcaccttctgggccactctgagagctagtgacacagggaccctatgcctggggctccgcatggtgcaggcagccaccccgggggcctcagggctcccctgcagccccagacaggccttggctttgtaccagtatctcttctggtgccccgcaagcccaggccagctcagggctgcactttggcaggtgcaagagggccgcgggtatcccccagggctggagctgccccctgtactgctgcagatggagtggagccggcgggcccaggagcagctcctgtgggacttggaactgctgactggtgtggagctgggcctcttctggccaccccaggcccagtttttcggtccgaggggccaggcccagcaagcatggagccagtgctgtcagccaggtggtagcacaggtggggaccctgagcagccgccccagatctgggtgaaaccgggagtggtgcagaccaagggtgggagagccctggaggacctgcagagcccacacgcggacctggcccagagggaagagaggagtgaggcagagcctgagacccagaaaagaaagctcactcccgggacccctgggccgggggacctgccctcccaaaacctgccttcccaagatgcccttgaagggctgggctcggacccgcacctgggccaggagagagcagaacttcaaagaccaccaaggatggacacccctgagtctgagaggaggaccctcaggatcagaaagcggagacccctcagcgtaagagagccgaggcctcctggggcgagatcaaagatgctcctcagagtcagaaggtgaagacacacgggggccagagcccaagggctcctcagggtcagagggaggagtcgaagagaatttagtcctaagtgccagggaaaggcgagtccccagagtccagggaagaagatgctgcggtcttgggaaggcaatatctcacaagcctgggaggtggctcccggagaggccactgtgcagcccccagaggaaggcgacccccatagccatccgagggactcctgcgggtccctgaaagcacagactccaaagcctgtgggcagggagagcccaaacctccggagaaggactaccacgctgacgcagagcatgatcaaaggcgagccacaaaggtcggcaccggcggtggcaaagctgggggccgcccgggagggggcgtgggctgcgcttacccgcccgaagcccccggcccggcggcggctcccaggtcgcggagccggagccgagatgccagcgaccctgcgcgccgaggtatccgggcagcaggggctcctcggggctctccggggcccccaggcctggagcgcgatccgcacgggctgcagggccctggagtgggccccgcaccgggggagcaggaggtgggccaggcttggcttccgggtgccctccggggtcgggtggggcggccctgagcgtcccaaggccttgaaggccgcgtggccggcgcccctcagcaccgccaaggcgcctgcgggcttaagcgcggcgcagcaggtgacggctctgcagcggctgctggagctgcacagcgcggccaggcggcagcgccgccggcgggaccgtgagcagcagcggctccgggtgtgtccccacgccgggatcggggcctgcctggagcgggcggggcaccgaggggcggccggacgctgactgccgcctctgcaggtcctggaacgcctccacatcgccaggaaccgccactgccgggttcaccccgtggggctcccgcccagtccggctcaactcccgccacaggaggacgcggctgggcggcggcgcgccctgcgggagcagctggagcaaatgcatcgggagaggacggagcggctgcgggccctcggggccaggaacacccagaacttcctggaactactgtgttcccctggtgctgaggatcccgtgcctgcgaagtagtgctcgcccttcccagcaccctctggtcattgctgagtcctcaaagggatgattaaagtgatgagggttacggaaaaagcaagagggcaacttgcagcccacacctggcccacggtcagagggccaggtctcggggatcaagcagtgcgaaggccccgttcttgcggaagaatgactcaatgcggcacatcttgcaggagaccagttcttgcttcactggggggcctgggaaaagatgaatccgtcagtggagtagccactttgtgggaagaaatagaaagtgctttggaggaatgggagctatgggcaaatactgggagctggctggatgccaggatacagcagccatctgccatcattaccctagcttcaggatcctctacctgcagggaggggggccaccctagcctgcttgtcacagggacagactgtggagagatgagatttccttcggcctcctgctccccgcttctagggctcgcctcctgcttttgttagaaagttatttccctgacttccccttt

SEQ ID NO: 465162 - DNA, 1102 bp, Homo sapiens
tgaaattcatcaaatgacttctgcttttctattaagttcaagtcctataggagtgctggctttagatcatggcttggcacttcagggctgcccactgcagctctggggcaatctcagtgtttatatttcttccccaaggaacagaggcaggcatagaggaagtgctctcgtttattgctttgagagtttccagaccacagggcaggaacggagagcacaagtggaagggatggagatttttgtggagagtccgtggagaccagactagagttcccagggcagcggataggagaggagagagctgcatggagaaacagctccctagacctgcagaagagccctcacgagtgttcaggacagcactgttcagcacagaatgcatgaaattaaaaagactgaccataccaaatgttgacaaggatgtgcagcacttgggactctcatacccagatgatgaaaatgtagaatggtgcaaccactttggaaaacagtttggtggtttcttagaaaggatcttcatgttgtagatgtatgtgaaattggccaaaattttcatccctgtttatataaacattctttgaaatgtgactttgcagctcctccaatcaacagctagaatctgtttcccgacctcttgaatcagacttgctttggccaatcaattgctgtggaagtggcagtatgccagtttcaagcctaggccttaaaaggacttgggcactttcactctcctggagccctccctgcaggatgagaggtttcaggataacctcgccttcataatcaaaatccacccctttgctgttaacctaaatacacatatcatttacgtactttcacaacttcagactctcatctgactcttaataggcttgcaacctttctgtgtgtctttgtatcattgtgactatactttcagtttaaagtatttgtagcacggttgtatgactatagaatctatatactccaaactggttttcagtagctccaaattcgtcttaaagaaactacttattaattgaatatgtttaaatttataatatgatgcaaccatatactatctgggaaggaagaaatagcaataaaatttcctccttggcca

SEQ ID NO: 465163 - DNA, 1937 bp, Homo sapiens
  misc_feature (2)..(3): n is a, c, g, or t
  misc_feature (8)..(9): n is a, c, g, or t
gnngcttnnggctccttgatgctgttgaccattaaagactaaaaagcgggatctggaaaaggtgactgcaaagcaaaagcaaagccagaagaggccatgatgaggcagatgatgggttccagtggccactatgaggccaaagatgggccagaagaggccatcatgggttcgactggccactatgaggccgaagatgggccagaagaggccatcatgagaaaggagctggctcagctcctgccctccgatggcatctccaggccccaaatggcctctggtcggtggggtcctccaggcccagcttgggcctcccagcggcctctgcagacccaagtcgtcctgaagtccagcccctgcctgttggcggcctctagacgccaagcctctacctcaacagtgggccctccaggcccacctcttgcctcgccatggcgtcctcgggccaggctccccgcctcggggctgcctccacacacccagctcaccaagtactcggcccacaggactgtgtccagcgaggcctcccgtggcgtcagcgtgttcgtgtggaggaatgtggaacctcactctgtggccgtgttcccctggtactccgtccccttcctgacccctccctggagccacacgaggcccagcaacctgccagtcactcagtggcctccaaccagagcaaacaacctgccaagttggcagctgttgctcatgagcatccaccaggtgggacagggagtgttgaccctgggtggccccctggagccacctgccctgaaagcccagggcccagaaccccacacactttgggggtggtggaacctggcccagtccctcagtgccctgcgcaaggaacaggactcatcttctgagaaggatggatgcagccccaacaaatgggacaaggaccacatcccgtggcccataagtggtggtcatgagcttcagcaagcggcaccaggccctggcagggcgcaccagggtcaccccaaccaggacaaccggaccgtctgccagatcctgagcgagcggtggtacaccctggggcccaatgagatgcagaagtaccacgacctggccttccaggtgaaggtggcccacttgcaacagggaccgaaagaagtacagctcagaggccaagcccacaagccaggggctagcaggagtatacaagggctcctgggagcagagggtgtacacagcctggacggcagggaaatagaccgtcaggcactacaggaactgacagaagtggtgtctggcactgcatcatactctggcccaaagccttctactcagtatggagctccaggccactttgcagcccctggaggagggggtgacaatgtcattgctgatgacggctttagcaccactgacactgatctcaagttcaaggagtggggggcagagcctgaagaggagaaactgggctttgggggttggggcagagggaaccccacggacatggatcccgcactggacgaccccaccacacccaaatgcaagatgagaagatgctccatctgcagcccaaagcccaacacccccaagtgtgccatgtgtgatggggacagcttcccctttgcctgtacaggtggagaagccaaggacgggctcagggaaccggagaccgagaaggcgctgtcctcttcactgcacgcgccctggaccagtgccggccctgatcgtgcagcttttccaggcccactgcttcttcctgtccactaggccacagccgctctccaggcccactatgcacacatcttcccctccaaggtttgttctgcccctgccctgactcccagccctgagggggtcctgtccccacctcacctggctcagactctgacgctgccctggctgccccaccactgcctctgcccaagagtcacgtgaggctgagagtaggggcaggggcagcaatggtgccagttggggggcgg

SEQ ID NO: 465164 - DNA, 2876 bp, Homo sapiens
cctccctgaacatctcctcaggaactttgggcgcctggtccgacatgatcgcggcggcccgggaggctccgcggcggcgcccggccccgcccaccccccgcccccggcccccgcggcgcccggcgcccccactcgccccgccaacggccctgcccgcgcagcccgggcccggtcctgcgaatcggggtccgctcccccgccctccgcgcccccgcccgcgcccgcgccgagcgcccgaagcgcgggagccgcgcgcgccctgcgggacgcaccatcccgccccggccaccgagggggagcgccgaggagccgcccggcctccagtgacgccccgcgcctctgccgccagccacggctccggggtagctggcgccggcagcccgctctggcccttgcggttccgtggccgccgctctgcaacgagggggccccgaggacgaggggaaaccagctcccccctcggcggggccggagtgagccggtcccggggaggaggggagctggcaggcccctcccgtcgccacatgcggctgctcgggggcggcgcatgcgcgcggcggagggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtaatcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgcctttttatcgacctgtgtgagagaacttatttatccttttctttttctttcttttttttgaaac

SEQ ID NO: 465165 - DNA, 2818 bp, Homo sapiens
cctccctgaacatctcctcaggaactttgggcgcctggtccgacatgatcgcggcggcccgggaggctccgcggcggcgcccggccccgcccaccccccgcccccggcccccgcggcgcccggcgcccccactcgccccgccaacggccctgcccgcgcagcccgggcccggtcctgcgaatcggggtccgctcccccgccctccgcgcccccgcccgcgcccgcgccgagcgcccgaagcgcgggagccgcgcgcgccctgcgggacgcaccatcccgccccggccaccgagggggagcgccgaggagccgcccggcctccagtgacgccccgcgcctctgccgccagccacggctccggggtagctggcgccggcagcccgctctggcccttgcggttccgtggccgccgctctgcaacgagggggccccgaggacgaggggaaaccagctcccccctcggcggggccggagtgagccggtcccggggaggaggggagctggcaggcccctcccgtcgccacatgcggctgctcgggggcggcgcatgcgcgcggcggagggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtaatcccagctactcaggaggctgaggcaggagaatggcttgaactcgggtgggggaggttgcaatgagccgagatcgcgccgctgcactccagcctgggcgacagagcgagactctgtctctgaaagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgcctttttatcgacctgtgtgagagaacttatttatccttttctttttctttcttttttttgaaac

SEQ ID NO: 465166 - DNA, 2670 bp, Homo sapiens
cctccctgaacatctcctcaggaactttgggcgcctggtccgacatgatcgcggcggcccgggaggctccgcggcggcgcccggccccgcccaccccccgcccccggcccccgcggcgcccggcgcccccactcgccccgccaacggccctgcccgcgcagcccgggcccggtcctgcgaatcggggtccgctcccccgccctccgcgcccccgcccgcgcccgcgccgagcgcccgaagcgcgggagccgcgcgcgccctgcgggacgcaccatcccgccccggccaccgagggggagcgccgaggagccgcccggcctccagtgacgccccgcgcctctgccgccagccacggctccggggtagctggcgccggcagcccgctctggcccttgcggttccgtggccgccgctctgcaacgagggggccccgaggacgaggggaaaccagctcccccctcggcggggccggagtgagccggtcccggggaggaggggagctggcaggcccctcccgtcgccacatgcggctgctcgggggcggcgcatgcgcgcggcggagggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggaggccgaggtgggcggattgcctgagttcaggagttcgagaccagcctgggcgacacggtgaaaccccgtccctactaaaatacaaaaaattagccgggcgtggcggcacgcgcctgtaatcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgcctttttatcgacctgtgtgagagaacttatttatccttttctttttctttcttttttttgaaac

SEQ ID NO: 465167 - DNA, 1499 bp, Homo sapiens
ttgagtttcttaagatagacttaactcactgaaatgaggcctcgatgtaagctgttcttcagatgtctggaaacaaccacagcaatgatgatttcttttcctgataaaactatttcctttctccaaggttttaaaggttttgacctgaacatgtattacccgaaccatgaggactctgatggaagagttatcaatgatgacgacttgggtggaaatggtctagagattcaggcagatatggctgcatcaccatcctataagggaagagataagactcctagagggaaaaaatgtagggtaatagggtttgggactgaagaaaggaccactgaaaatgtccatgtgttggtcgctgatcgtggttatggaggaggtgtcttcaaaagcatcaaggaaaaaatatcaaatattttgatatttgatatcaaatatcaaaatttgccatggtgcccagcatggttcaagatcataagtgtcaagcacatcagggcaagaatcttctgttccatatgcaacatcttctggcagccttgtcctttttctgtccttgacgactacaataacaaacagctgttgccgaggcattgctgttgacgtgttacctttgaaacctccctcctgttatggaataagcctcttccagatcatggctcattatcatctagtctgacaagcagccttgttgccacggagacccaaagggatcaggcgtggcatttgcctgcatcatcaccccctccaggggaactataaggactcttctgtgcgtcatgcgtggctgtcctgggactggctgccaccagacttttcctgcgggtaaaacctaaacaaatgatcagctgcagataatatcaagacctctgtttgatatgttaatagtgacagccagatttccacaattaacaacgaggtgggaagaaaacactgtagtcaccagacttgggaggagagggtttgtattcacataaacacaacctcacgtcactgcttgccaccacaaagggctctgttcactgttttgttctcaaagatcatccttgcgctcatcctctgatcttgaatttctacataactttctcagtttatatgccctgtggcaagtgcagcaagcactgtttcctgtttctaaacttgtagaaaatcatccatacatcttacagttgtcagttttaaccagataacagtggcactttgttgctgcttttttatctttagcttaggttaacaggaccctggaagtaaagttgttgatttattcaatagagtattctcaattaatttggctagatttctacatgattcaaaatctaaaaaagtagaaatgcatgcttacatgtctaaggcctgaaaaattggtagtgacatcccaaaataaatgaaggttttaaaacaataaatgatctctttttttttttttgcttctgtgcttggggagaagcaatgaaggaaacaacaatgttgctttaaggagtgatggctgcttgaggctgatttttata

SEQ ID NO: 465168 - DNA, 961 bp, Homo sapiens
ttgagtttcttaagatagacttaactcactgaaatgaggcctcgatgtaagctgttcttcagatgtctggaaacaaccacagcaatgatgatttcttttcctgataaaactatttcctttctccaaggttttaaaggttttgacctgaacatgtattacccgaaccatgaggactctgatggaagagttatcaatgatgacgacttgggtggaaatggtctagagattcaggcagatatggctgcatcaccatcctataagggaagagataagactcctagagggaaaaaatgtagggtaatagggtttgggactgaagaaaggaccactgaaaatgtccatgtgttggtcgctgatcgtggttatggaggaggtgtcttcaaaagcatcaaggaaaaaatatcaaatattttgatatttgatatcaaatatcaaaatttgccatggtgcccagcatggttcaagatcataagtgtcaagcacatcaggtaaggaagataataataattcaagggcaaatgaattgccccatggacagtgaattacagtatgctacaatggatttgtttggaccatttatcttttcttttgaattgacttaactgtacatttgtaggagataagcaggaaatcagaagcactcctagggattggcactggtctaaatgacagccctaaggaggagcttagataccagattcatcctccatccaggcagaagctccccagggataaaactgcaaggttaaatgtgaaactcaaaatttgaagcaaaagcctctcctcttctgcacttcttttcttcctaagttgagcagtaatactagaaacagagtcaattgaacctgaatagctcctctggggtaccaggcatcattctaaggaactcgtttcatcctcacagaggcacagatggggtatgtaacttgccaaagctcacactgcttggagtagagtcagg

SEQ ID NO: 465169 - DNA, 1264 bp, Homo sapiens
accgaggcacagcctcagagctcccctccaaggctgaaccctgcatctgctccatcgcctgcaccatctccctcctctcttctggacctcataatttcttactttcctatgcctgtaaatggtttgctgtgaccagagaagaagaaggaaacacgttgaagtccttgtcctggaaggcctgagtctggaaaactgtctcagcaaagcaagagccagtgaagggacacactgcgaagagcaggaattcttccgtcatgatccacagtctctgttgggttgcagtagtcaccgcgatgctcataaactgagaaaaaatatatatatgtctttttcactttattggcaaatattacataagtatataaatttcactttttacagctaaaggctgcatagccataacttctgagcaatttattaaggttgaataaaattgatataaggaatcattttataaaataaaatcttgtgcaaatgtgtatgtttttattttataaagtgcatagctagtaaatctgcgtctgccccacacatcgctttctcattccttgttattccggcattcaagcacacacacgcaccaacatgcacgtgcacacatgtgcccaaacacatacacatatttatgcatgttcacacatacacggacgagtgcacagcacaccatgcctcactaccggacaatgaggttaggtgagtcgcatcaaaccatggtgccacttatggagccagacccagccgccctcctcagacctcgggggactcgggctcctgcactggtccctgcttattccttgtgtgggttatttaaccctctctgcctacctcgatgaggccctggcggtcaccctcacaaagccagttttggccctggagaagttttgctgaatcaagcacctggagtcccaaaagctgtgccgccagaccggagctacccacactgccttcccgccccacagcagaggcctctgacatcacactgagtgggcattattttccttatccatcagcacgaagaggcaaatattctggcagtgttccaacagatggtgtctattcagggtcacccgaaagagttcccactgtcacctccatgccttccgccctctgtggctgcccagtggcaggggcccctcaccccacactcagaagctggagctctggggaacacaacggacagtgttgacgtcgagtttcatacataataaaaatgagggcactaaaagcaaattcactaatggatatggccaacttaaaaggggtc

SEQ ID NO: 465170 - DNA, 879 bp, Homo sapiens
tccttgtcatgttcccttgagcatgttcctgcctggcctctgggagcccctgtccctaccagctggcactttctattgccaggtgctcaggatgctgtcctcaagtccaccctgcactgtgtggccccaacattttctccctcttttgctcggcagtgggggctcccctcctgtgaagctctccaagatgccctgcactgattcgggtgctccgcagcgaagccccttttgccaggtgcccctgccactgcccggctccccagctgcttggctgccatctgcctccattcctgctgcggaggcctggaatgcccgggatactagggccactctgccttccatgctgaagaaggaagatgaatcagatggaggtggttctgggccagagacaaatctaagggaaagaattgctgtttctcctgcacggcagaggagcggctgctgggtaagcagccctttctggctgtctctctccaggtgaggtgaatcatctctctggaggctccctgagctctcaggtgacatcaccattgcaaaatctaagattggtacttgaggtatttttcagactgcattccaatgaacaagctggtgccacctggactggtaccccataccatgaaactggctcatctgaccttgcaatcccacccaggaactgacagagtgtaagaagacagctatgattttatccctaacccaaccaatcagcattccccattccctagtcccctgccttgagaaaccctagcctctgaattctcagggagactgatttgagtcataaactcccatttgccacttggctagtcctgtgataattaaactctttctctactgtaatactgctgtctcagaagattggttttatctgtgcag

SEQ ID NO: 465171 - DNA, 688 bp, Homo sapiens
agatggcattgtaaacgccagagcgaggttctgcctaccccgagactgctgctgttcggagacctgcaggtgaatgccccatcaccatgtctgacctggaggcaaaaccttcaactgagcatttgggggataagataaaagatgaagatattaaactcagggttattggacaggatagcagtgagattcatttcaaagtgaaaatgacaacacctctcaagaaactcaagaaatcgtactgtcagagacagggcgttccagtgaattccctcaggtttctctttgaaggtcagagaattgctgataatcatactccagaagaactgggaatggaggaagaagatgtgattgaggtttatcaggaacaaatcggaggtcattcaacaggggtgcttgtttgtccttatcctccttcctgtggtgaggcactgatgcagagtgtgtgtggggtctcccctggccccttggctggcagagagcctcacgttccacctactttttcttgcctcgcagtcacaggggcatcaaaccacagcaacagcgtcttaacacccggaagattaagttacctcaacccaagatcagttccactttaaaaaagcactttcgacccatatttaaccaaccgtcagagaggattcaaaagagggctaattgagcactgagtgtttgaagcattcaaatcaag

SEQ ID NO: 465172 - DNA, 1539 bp, Homo sapiens
caggctgggatggcttagaggtgttattctgaacatcatgaggggccaacaggagcatgtgtgtgtgtgtgtgtatgtatgtgttgtgtgtgtattggggaagaaggccatggctgatgcaattggatctatttgggggagagaagaaggccacggctggagagaaagaggaaaaagaaacacaattcaaaagccagaatatctgtgatgaacttcgaatgcagggttctggtggtcggaaatctgagatcagggctgccagcattgggttctggcgagggccctctctgtggcttcagggagtgaggttgaggccatgccagaggctccgggcctgggagtgggtcctgcctggccatgcgagggtgggagtggggcaatcggctgccttggggatacagggcaccggggacatggggaacaggggtcccaccaacaccactgctgctcccgcagccgcttttgccgccacggtccctgcccccactcccgctgcagccaatgcagatgctgctgctgctgccactgtttatgaagcccaggctcacctggccacgcggaggagagccaaggctccctcgaggaccccccagctgaccatcaccacggctgacccccagacacgtgaatgaggccactgcagaccatccaggcctagctgacctaccaggtggctgcagccacgagagtgaccccagcccaattaatttcagcccaaattgctgaatcacaagattgtgagaaaatacacggttattttaagctactaagttacagattgctttgttacatggaaatagatcaataagatgtaggaaaataaccagttatcacagtgcctgccatggcagttggtaactgttttgcatatcatccctgcccattagagtgaacaatattagcaaaggcactgagaaggaataatcttggcctgtttatcgaacgtagacacagggtttcaccgtgtgagccaggatggtctcaatctcctgacctcgtgatccacccgcctcggcctcccaaagcgctaggattacaggtgtgagccactgcgcccagcacactcttcaaaaactcttgaacaagatatgatgagcttctgcgtagcgaatgcatctttgtgcagggagggtggtgtaccttaactccacaaaggatcaaagcttctacactcaggacccttctggaccttgccctatgcacctcttcatatttggccatagtaaaaaatgatcacccctggaagttcctgttatcactggcatctcaacatctggaaatccctgaatgagtccagctttttaatttaacagaatagaagtgaggcccctggcagggaagtgtcttgcccaaggtcacaaagctggttagcaaataagggcattggacctgagaacttgatgcccacgctccctcctgccctcctcctcttctcagggcactgcactggaacactgggtgttcctcacgtgattgggtgagacccatgaaatgcatgaggagaataaaagtctcgtgttgacatcagcgaccaaggga

SEQ ID NO: 465173 - DNA, 1336 bp, Homo sapiens
caggctgggatggcttagaggtgttattctgaacatcatgaggggccaacaggagcatgtgtgtgtgtgtgtgtatgtatgtgttgtgtgtgtattggggaagaaggccatggctgatgcaattggatctatttgggggagagaagaaggccacggctggagagaaagaggaaaaagaaacacaattcaaaagccagaatatctgtgatgaacttcgaatgcagggttctggtggtcggaaatctgagatcagggctgccagcattgggttctggcgagggccctctctgtggcttcagggagtgaggttgaggccatgccagaggctccgggcctgggagtgggtcctgcctggccatgcgagggtgggagtggggcaatcggctgccttggggatacagggcaccggggacatggggaacaggggtcccaccaacaccactgctgctcccgcagccgcttttgccgccacggtccctgcccccactcccgctgcagccaatgcagatgctgctgctgctgccactgtttatgaagcccaggctcacctggccacgcggaggagagccaaggctccctcgaggaccccccagctgaccatcaccacggctgacccccagacacgtgaatgaggccactgcagaccatccaggcctagctgacctaccaggtggctgcagccacgagagtgaccccagcccaattaatttcagcccaaattgctgaatcacaagattgtgagaaaatacacggttattttaagctactaagttacagattgctttgttacatggaaatagatcaataagatgtaggaaaataaccagttatcacagtgcctgccatggcagttggtaactgttttgcatatcatccctgcccattagagtgaacaatattagcaaaggcactgagaaggaataatcttggcctgtttatcgaacgggactattcatttccctggctacgaggattttaaaaagcaagaagaaatttattggcagatctgatcacccttatgagagagcaatcaagtaagacagcatgtagcccctggaaattgctggaaatcatcatgtggccctaaggagtgccagcctaacgatgaagcagaaagagggatggcgagatgactgaactgttgagtcaagtcacatccaaagcccatgtggcctctgatcttttcagataaatgagttattaaatattttatttaaaccagtgaaagtcaggctttctcttatcagggacagaaagactctcaactgatagaatatacaatacaagcaagctttgtaatttgcaaatgaataaaaacatttttaaaattattttt

SEQ ID NO: 465174 - DNA, 1485 bp, Homo sapiens
ttactcacaacgcaggctcctggggccctccagagactccggtgtcagcgagctcatggcgcccacctcaagtaacactggcctcgggcactgattctcaaccctggctaaccactaaaaatttactcaaggagcttttaaaaagtatcagtgcctaggacacaacacaggttaattgaataagaacttcgggaggagactctagcaaatagcagccttggtgggatgaagatcattacaaaagaatgcaaagagacagagtggacagtcccttccgacacgcaagccaggacagacacagaaagaaaacctttggaacaggaaaagaagagctcttttgacaaagcaaaggaggatcacagagttccagccctgggggctgcgtctgggggtttcctggcattagaggagctgatggtgaattttccctcaaccatcaccggaaatgtgaaactcagtggagctccctgttcccacagggtcacattcaagcacaattcaaatatgaatacagtaaaatcatgagatcccagctactctcaacaaggcttacccacagcgtttgtggattttgtgccaggcactgagctgggtgctggatatggatgggtcttgtctgtgatctacggagcctgctgtttagtgggggagacacaggccttcgcccttcacccaccaagccctcgtcgttcctcttcaaccccagcatccccctgggttcctgtgcaggcctcggcttccaggaaccctgccttggagtgtgtgtgtggctctgtgaccggcaagcaggaggccacggctgtcccaccctcagggctctcacatgctgggtcccaggatccagctccgtgaggctgcccaacgcagagcagagggcagaggcagcctgggtggcccagccactgccccaacctgaggtctcccagcagcaccaggtctggaaaatgcgaatcccaagaaacataaaagaaaccctgaggatcacaaagaaagctgcgctcttgagaaacaaatacataaacaaaaataaaaaggagaagagaagcaactgaaggtgaggttcctggaagcacagggcccttgtttcaccctcagtgggaagggggcttcctggaagcacagggcccttattgtttcaccctcagtgggaaggggcattcctggaagcacaaggcccttgtttcaccctcagtgggaagagggattcctggaagcacaaggccctcgtttcaccctcagtgggaaggggcattcctggaagcacgaggccctcgtttaactctcagtgggaagagggattcctggaagcacgaggccctcttttcaccttcagtgggaagggggattcctggaagcacaaggctctcgtggggaaggggggggcacctgctgcaccatcggaggttttctttttcattctcactcatatgaacacaacacaggcaccttttcagtgtttgtaaactaccctttctattccgacca

SEQ ID NO: 465175 - DNA, 898 bp, Homo sapiens
tggcaaggctgccgttggcaaaagcccagctctgccatgaatctccgttcagttactggtttcacactcatttgtgagacctcaaccctcacccccaggagatcaggtccggaccatgagctgaccctggactcaggcaaggtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcggcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcc

SEQ ID NO: 465176 - DNA, 1492 bp, Homo sapiens
tggcaaggctgccgttggcaaaagcccagctctgccatgaatctccgttcagttactggtttcacactcatttgtgagacctcaaccctcacccccaggagatcaggtccggaccatgagctgaccctggactcaggcaaggtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcggcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctccc

SEQ ID NO: 465177 - DNA, 1371 bp, Homo sapiens
acaccaggtaccactggcaggtgccatgcacgtgaacgcggagtctgctgttggaaatgtgttgggaagggagagttcccggaagtcaggtggcaaatcataccgggatggggaggagtgttccattcattcagagggaacagaaggtgagaaggaccaaagaggaagagagccaagcttggagaaagaattggaaggcagccagtgtgtctgggggccatggaatgaagacaggatagggacagaggagcaagaaatcaaggcaggcccgtgtgaagaccggggatttgactctcaacctgcccgctctgcacaccagggcggacacccacagacgcgtccttcacccgcgcagggacctgccaggggcgcttataccggagggtgttcagagcaggaaaggaagagatcaaatctgaacccggatccgtctcctacagaacctgagtcgctcaatcatcagctagatcgccccgtgtagacaaagcaagtggaattatttgaagagtataccttgagctgggcaatcctcatagaaggtcggggacgacctgcccttcagtgttcctggagcatcttctccaaagtggaggtcgagccaggcctaggaggaaagagagggcaactgcggacgaccccaccgcagaagaggtgaaaccgacgggctccagggctttttcactcattccctaggcatgtgggacctcgaagatgccgaatcagctaaacgggaggtggcttgagtaggatttgctgccagctaaagcgtgagatgctattgcatgtgcaaggcaaggctttcttcagcggcatcatcttccaaaatagcccagtgagcatgcctttctcctgaaaaataaaaaatagttggtgtttactgcaatcgtatggcaaatactgtgttgagagattaatttacatgaactcatagaaccctcagggcaagtttatgagccgtcttgtctccattttacatagttttcagctttgctggaggaataggcctgctgtactttttggaatttcctcagccactcatcatttcaggctgaacattaatgatttatccagcaaaggttattaaaattgactatagtctctgaagaaaggatagtttgtcaaacccacatcttaagactcattggatatattttgcatgaattgtgattaatgcaaggtaatttcagaggatggcttttgctaattaataaatcaatcacattgactcatcttggtagactgaactttaaaagttcattactgacttgctcaaaaccagaatcccacacatacatagtttagtggtttaaggcaattcttaagaaagcaaacagattgagcaatactttaattcagaaacaaattgcttaa

SEQ ID NO: 465178 - DNA, 1160 bp, Homo sapiens
acaccaggtaccactggcaggtgccatgcacgtgaacgcggagtctgctgttggaaatgtgttgggaagggagagttcccggaagtcaggtggcaaatcataccgggatggggaggagtgttccattcattcagagggaacagaaggtgagaaggaccaaagaggaagagagccaagcttggagaaagaattggaaggcagccagtgtgtctgggggccatggaatgaagacaggatagggacagaggagcaagaaatcaaggcaggcccgtgtgaagaccggggatttgactctcaacctgcccgctctgcacaccagggcggacacccacagacgcgtccttcacccgcgcagggacctgccaggggcgcttataccggagggtgttcagagcaggaaaggaagagatcaaatctgaacccggatccgtctcctacagaacctgagtcgctcaatcatcagctagatcgccccgtgtagacaaagcaagtggaattatttgaagagtataccttgagctgggcaatcctcatagaaggtcggggacgacctgcccttcagtgttcctggagcatcttctccaaagtggaggtcgagccaggcctaggaggaaagagagggcaactgcggacgaccccaccgcagaagaggtgaaaccgacgggctccaggtaggtgtgtcctccccaaccacaccctcccacagggcccggagactggggaaggccggagatgagattagggtcagagccacacccctgacccgcgtacaggacaaactgaagccacgcgtctacactggcgctccgaactgcgttggcccaaagcttcttcaccgcttccagcggagggcttaaagcggtccccccagccctcacacagcgggttttctcagaacccagtctccagagaccgcctggattcaaatcctgccgccgccctcagccgctgggagagccgggccttggcctcaccttcttcccagcctcacctgcagaatgggcgtgtcccgagggttaaatgccctcatcaccatgaagccttaaaacggtgcctggcacatggcgatacgcaataaacgtccgccaaaatgacgttagccaggattcgccccggaaggcttcctgttctcatacagcccttcaatgagggctaatccc

SEQ ID NO: 465179 - DNA, 826 bp, Homo sapiens
atttcacacgatatgtatgacaagaagcctgaagaagctatgaatttccagattgatgtgaaagaaatccactctgtaccttggaaatggtatggggtggaaagcggcgaacgcagcaagggttcaggaaatgcctggcttgtgagtggaggagaggattctagcaactcttcatgcttccaagtgatgtcattgggaaaccaatcctggagaaagggggccgtcgctgataaaaatcactggacatggatggagctggaatccattatcctcagcaaactaacacaagaacagaaaaccaaacaaatgctgcatgttctcacttatatgtgggagctgaacaatgacaacgcatgggcacagggaggggaacaacacacactggggcctgttggtggcaagggagaagtttcaaaagaccctgaacagcaaaagcagtctcgagaaagaagaacgaatttggagacatcacatttctgatttcaaaatatattataaagctaaagtaattaaaacaatatgatactgacataaagacatacatctaaaccattggaattgaatagagagaccataaataaagtcacttgtttatgatcaactgatcttcaccaagggtatcaagaatacacagtaggagagggtcgtctctttaacaaatggttttgggaaaactggatattcaagtgcaatagaatgaaattgaatccttatcttacaccatacccaaagatcagttcaaaatggattaaagacttaaagctccacaggcttgctctggaccaaatgtggatgcatttcacacagcctcctgaagtgagctgcc

SEQ ID NO: 465180 - DNA, 1052 bp, Homo sapiens
cggcaagcaagtcacggtggacgcctcagatcgcagagaaattcagagacgccaacttaagaagactaaatgaaaacctacaagaataaacatcaaggctcaatgtgtcagtcttcagttggtttggtttgtttttttaccccaagttttaaaagttatgcagcccttagaaagttcagcagtcagtgtgtttatgcttctcgttctctaactcgtatacggtgcgcctatgacacttctcggccagcaacagctgctctagcatgcgccgtccctggtgctgagcacaggccctggtacaaagttgatgttcaatgtttgactgggaaatgtaaagagatagtcattacatggacatctggagaaaaaaacagcacatggaagtatcaagtgttctggggccgcccaggcagagggaaacaagagctagactacctgctcgtgatcccaggaggctaatggaacagtgatgtatcgcggttcctgcctcgtgaatttggaagcaggattctgctcctagacatcttctcctatggatttctcctgggcaagaatggcatctcggtgcaggacccgcagcactttctctggctccgcagacccgtaatgagcctccagaacctcaggcttggttttctctgtcttcagcatgtggatcacatcttctctggcctgtaatagaaagtgcagcaagatcagacgactgacaatgtaaatcgcatactgggctcaaaaaatcaacagagagcttattgaatacatccccatcttgtcagggctattggcaaattcactgggtattctgctctaatttttttttttaaccaaaagcagattggcaagcagatactctgcttcaggttgctaggaagcaggcaagcagaaaaaaggatttgtgctaatattaactacataaaaattgctttatctaagtagcaataatttgggatggggtgggggagggaggcaagcagggctggtcctggcatacttaacctgttccagtgcacatgaggtcaatgacagtctaaaatcttctagttttctattga

SEQ ID NO: 465181 - DNA, 689 bp, Homo sapiens
cggcaagcaagtcacggtggacgcctcagatcgcagagaaattcagagacgccaacttaagaagactaaatgaaaacctacaagaataaacatcaaggctcaatgtgtcagtcttcagttggtttggtttgtttttttaccccaagttttaaaagttatgcagcccttagaaagttcagcagtcagtgtgtttatgcttctcgttctctaactcgtatacggtgcgcctatgacacttctcggccagcaacagctgctctagcatgcgccgtccctggtgctgagcacaggccctggtacaaagttgatgttcaatgtttgactgggaaatgtaaagagatagtcattacatggacatctggagaaaaaaacagcacatggaagtatcaagtgttctggggccgcccaggcagagggaaacaagagctagactacctgctcgtgatcccaggaggctaatggaacagtgatgtatcgcggttcctgcctcgtgaatttggaagcaggattctgctcctaggaaaagatgagaatagagctccagtctattcttgctgcagtaatttgaaaattatgggaccatcaatctgttgtgaatgctgtctacagcagatcttatctctcagaattatcaaactgagctgatccaaaggcttgacataaattacatgttaaacgtatagtaagtt

SEQ ID NO: 465182 - DNA, 958 bp, Homo sapiens
cggcaagcaagtcacggtggacgcctcagatcgcagagaaattcagagacgccaacttaagaagactaaatgaaaacctacaagaataaacatcaaggctcaatgtgtcagtcttcagttggtttggtttgtttttttaccccaagttttaaaagttatgcagcccttagaaagttcagcagtcagtgtgtttatgcttctcgttctctaactcgtatacggtgcgcctatgacacttctcggccagcaacagctgctctagcatgcgccgtccctggtgctgagcacaggccctggtacaaagttgatgttcaatgtttgactgggaaatgtaaagagatagtcattacatggacatctggagaaaaaaacagcacatggaagtatcaagtgttctggggccgcccaggcagagggaaacaagagctagactacctgctcgtgatcccaggaggctaatggaacagtgatgtatcgcggttcctgcctcgtgaatttggaagcaggattctgctcctagaattatttcaaacacaccagtaaagccagaggtaaaacagccactgagctggggtcttgttctgttgcccaggctggagttcagtggcacagtcatggctcactgcagcttcaacctccaaggctcaattgatccccgcgcctcagcctcccgagtagctgggactacaaatcctgaagtcaaccaggaactggttgacaatgatatgcattgacctctactgagtttttgtggtcaggaaccttctctgagctgtcataatcgtgcttcatcatctccaagcaagtggtcagatgaaagcatggtgaagatgactaaatagaagaggcaggtggatgagatcagttaaccagcatcgccagatttctcagcactgaactcacttcatgttcaacagtggccagtcttgttaaataatattatgggaatatccctaga

SEQ ID NO: 465183 - DNA, 3836 bp, Homo sapiens
caggttggtgacagcagaactcagagccccttctgagggcagagccccatgtggctacacgttacatcccttgaagctggctctgttctcactgggggtccatggtatggcagcatcctccagtaccacaagatggggtctttccggagctgagcagggcaaggacaggttctggctggacccagggaagcccacctgcaggtgtggcctctatctctgcagctcacagtgggaatctggcccacaggacccagcctgccaccctccagggagccgtggagatttcaggatttctcctctgcgaaatggggataacagctccctcttcatccggttatggtcagggcgacgctaatagcctggccgtgggagcagctgcttatgagcctggcccgcagccgggccctggttaaagaccttcatgtacttcattccacgctcccagcaacttcccacagccagcacgtcacggtggcacatcccaaatgtcaagccctgaggtctagctctgggtcatggcttctcaacgttggcactattggcatttggagccagggaacactgtcccgtggggctgtccgaaatcagacctgcagcagtgtctctggcctctacctcctaggtcctagtcctgcctccaacactcactccaacactggatcacaattcaacatgggatttgggtggggacacagagccaaaccatatcagggaaccagcatctactgcacagaattccttgtgcctagttctgtgcttagaactgggaacagtggtgctaaaacacagatccaggccctgccttccacgagctgcctggttcctgggtccctctgatgcctccctccttccccacaccccccacatctcatccattggcaaatcctggagctctacttctttttaaaaatagctctattgaggcatctttggcgtacaatcaactgtaccatttggtaacttttgatctatgtatgcactgtgaaccctcaacaccatccacatgctgaatatctctgtcactcctggtgagctctctctcccgccccctctcccccaagcaaccactgatcttctcagtcactataaatgactttgtatttcctcgagttttatatataaatggaatcatacagtatgtacttttttgggtctggcttctttccttcacataattattttgagatgtgtgcacgttgttgagtgtatcagcagttcatagctttttatttctgagtagtagtctgtggcatggatataccccggtttgtttatccattcacttgttgataaatctacctcttttttacaatgcaattatgcattgaagcataacatgcatacagcaaagtgcataaaacattcatgatagtttgacagaaaaataagatctagtgtttgatggatcagaaggggactggagttcacaatactctattgtatatttcaaaatagctagaagagaataatttgaatgtttctagcatgaaaaaagacaaatatttaaggtgatggatattgtaagcagactgatttaatcttgactaatgatacgaatgtattaaattatatgtactgaaaaaaatgatatgtgaccagatgagtgcattttcatgaagtacacaccctcatccatgtaactatagcacccagattaagaaacaagacatggccagaccccagaatcccccctgagcccctccttgtccctgccttccattcccctctgtgttctgacacatagatcacactgagggttcttgaacttcatctgaatggatcacacaatacattattcttttgtgcctggcttcctccactctacgttatgactgtgagattcattctctgtgttatgtataccagtagtgtgttcctttttacagccgagtaatattccaccgtgtgaatacaccacagtttgtttctccggtcccctgttgcgggacatttgggctgtttccagtagttggccatttcagataatgcacctgcggacattgctgccatagcttttgtgcctgtgttttcatttctgttgggctgtgcccaggagtgggagtgccaggtcctagggtatgcatagggtcagctttactagatattcttcctcttaaattctttgtaagaccatttgctctccagctgtccaccaccatcctagccccagaagctgccatttgcacccgggtgacttcaacagcctttgaacaggtccctgtttacccctccccaatccactctccacatggaagccagagtgagcgttcaaaatggcaatttgggttatgttgttgccctgtcttctcatgggcctgaagcccatcaggccctgcctcgtcccacccctgactgcccgcatgagtttcttctggctgctgtgacagattgccatgaactccatggcttaaagcagcacacattatcctaagttcaggagctcagatgtctacaacaggcagcaggacccatccctttgaggggctctaggagataatctgtgtccttgccctttttcaggttctagaggtcacctgcattcctcagctgcaggccccttcctctgtggcttccatcctccaatctcctctctcactgtggctctccttcagctcccttataaggacccctgcgcttgcactggggccctggctactccaggataatttcctacctccaggtccttcacttcattatatctgcctggtccctttgccttgtaaagttgcatattcacaggttccgcagattaggacgtggacatgggggagccgctgcctctctgcccaccgccctgtcatccttctctggatacactggcctccccgctgccccatctcaaggaataagccttcttccccttcagctttggcagatggccctggcttttgcacacctggtctccctctgttcatgttttccacttgtctgccactgcattatccagtatgaccttgttcacttacctgttcgaacatttctgcatccccatcctactcctccctgcccccgttggtccctggagcaggggccttggctgtttggttccccgctgtggctctggttcctaggcgtttcgtgactcatggaaggtccacatttgttgcctgcctagggccttccgtagtgctgagcactctactcatgcttcctgggtcaactctaacagcaaccctctgctgtgagtgccagtaacaggcatgaatttgcaggtgaagaaaccacagcataaacaggtgaagtgacttgtttgaggtcacacagcttttaagtggcaaaatcaggattcatgcccaggcaggtgggctccagagggctcgagggtcttgggccgccttgtgggcagggctttgtctccttgtagctgttcttctgttcacagcaaaggcaacctcatccctttgagcccagacagtcatgcctttgggatgtgtccacttcagaacagggtctgtgcttgacttacgcataatgaaagctccactgagggaagtccccctgggtctgccccatggtgagcgcgggcctcttaaggagccacctgacacactcctaaaatggacttttcaaggtcccagctaaagcccagtgtgcttctcctcctccccggcagtcctgcaggaaggtagcttttcatcagacaaggaggcctgctctgggctgggggcccccaaccccctcccactcaaccgaacaccagatctcctcccctccctctcaggctcctgtgttacctgaatagcctgtgggtgggtctccctattgttccatagtcagatgcaaacacgaagttgaagtaccattaacttgggggatgagtccgttttcacactgcc

SEQ ID NO: 465184 - DNA, 1488 bp, Homo sapiens
cccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctgttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcaggggccgactacccagatgagctgcagtgcctggacgctcctgtgctgacccaggctaagtgtaaagcctcctaccctttaaagattaccagcaagatgttctgtgtgggcttccttgagggaggcaaggattcctgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctc

SEQ ID NO: 465185 - DNA, 238 bp, Homo sapiens
tgtggtggaattcattcttcaggaactcagagtggaaccaggaggtttggctggtggaaaagatcttcggtgagtggaccaagaaggggcagcccccatgcggcttctttctgccacccatacccacagcccacatattctggctgcgttccagggcgatcctcaccagtagccaatgccctctggctgtctcctccttccaccttgcctgttaagctcgagcaaatgtttggtaatg

SEQ ID NO: 465186 - DNA, 1276 bp, Homo sapiens
  misc_feature (4)..(6): n is a, c, g, or t
  misc_feature (8)..(8): n is a, c, g, or t
ggtnnncnagcccggttcctcctaccgggtgcgctgggaaaagggctgctcctgacagaagggacactctaagagcagcccaggaaccggtgcacttgggcggcctcggaagaagccggggctcctggaggcggaggcgaggcctgggacccaataagaagggcgcggctagagaggaggggctggccaaaagcccttgaaataaggcccaggcagaaccgcggttctagtctcccagctccagctcggcctttgggtttgctgtggtgtccttgtctcctgcaggaccggccgcagcatggacgctcccaggcggtttccgacgctcgtgcaactgatgcagccaaaagcaatgccagtggaggtgctcggtcacctccctaagcggttctcctggttccactctgagttcctgaagaatccgaaggtagttcgccttgaggtttggctggtggaaaagatcttcggccggggcggagaacgcatcccgcacgtccagggtatgtcccaaatcttgattcacgtgaatcgattggaccctaacggcgaggctgagatcttggtatttgggaggccttcttaccaggaggacacaatcaagatgatcatgaacctggctgactatcaccgccagctccaggcgaaaggctcaggaaaggccctcgcccaggatgtcgccactcagaaggccgagacccagcggtcttcaatagaagtccgggaggccgggacgcagcgttcggtggaggtccgggaggccgggacccagcgttcggtggaagtccaggaggtcgggacacagggttctccggtggaggtgcaggaggccgggacccagcagtctctccaggctgccaacaagtcggggacccagcgatcccccgaagctgccagcaaggcagtgacccagcggtttcgcgaggatgcccgggacccagttactagattatgaaggcatctcaggccctggagccagagccagtcaggggttaaagtgaaagcccgtatttccgcccagaagctggggttggggagaggatgtggattttttgttttaccctttctgttgcatggttgcaaacacaaacttgagttctaataaagaattgcaaagtggaagcccgccccccgcctcccccccgcctcacttaagtccaggaagctggggtggcgaggaaggatgatgtggattgtttttgttttacaccttctgttgaatggttgccaacacaaacttgagttctaataaataattgcatttccctaaaaaaagtat

SEQ ID NO: 465187 - DNA, 796 bp, Homo sapiens
tcctactagggtattcactggtatggctcagccacctgtttataacctggattgccataacatagcagctctaagatgcatctgtgaaggatacttattatactatctctgttgtgctttcaatagcagctgtcctggttacaaccttgctctgatccacaagagtggacacttggaaatttctttatgcgatgactttggctccatccctactccaaccacactgatttgtcaagggaggtgctatctctgctgtgactctgatatcacgtgggacccctggctcctctttgacctattctttttgcctttcattctcttccagccccttcttggtaggcctatggaaattgagagcaagtaccttttacctgggaaggggaaactcatcaaatgctatctgctcttgggacccaatcctgagttactttatcagattaacctgatagtcaccagaactccattcaaacagaacacaggactgttatatttgggtcagtaaaggacaaagatctggtgtctggactgcaggtgctgtggtatcgttggaagcaaagatggaaaacaaagcaggagatgaagggttcatagagataaacttcttcctattttgcctgggattccaggtagcagaactggagctcagacctcttttggggggatcctaagcaatacttttgctgctcccttctggtccacatcacaagtctggagaatctaaaacaagctgggcaatgagaaaatctaactcttcatgtgttattcccaataaatcagttatgacataaactttatg

SEQ ID NO: 465188 - DNA, 1290 bp, Homo sapiens
tacgggttgctaagtccactagccattctacagtgtcagcggggatggcgaaggtggggtccctgtgtcctgggaaggacagggatgggtgggaggtgtgtaggctgccatgtgacagcccccttactacagcctgtgagctggatggagaggagtttgctgagggagtccagtgggagcctgatggtcggccctgcaccgcctgcgtctgtcaagatggggtacccaagtgcggggctgtgctctgccccccagccccctgccagcaccccacccagccccctggtgcctgctgccccagctgtgacagctgcacctaccacagccaagtgtatgccaatgggcagaacttcacggatgcagacagcccttgccatgcctgccactgtcaggatggaactgtgacatgctccttggttgactgccctcccacgacctgtgccaggccccagagtggaccaggccagtgttgccccaggtgcccagactgcatcctggaggaagaggtgtttgtggacggcgagagcttctcccacccccgagacccctgccaggagtgccgatgccaggaaggccatgcccactgccagcctcgcccctgccccagggccccctgtgcccacccgctgcctgggacctgctgcccgaacgactgcagcggctgtgcctttggcgggaaagagtaccccagcggagcggacttcccccacccctctgacccctgccgtctgtgtcgctgtctgagcggcaacgtgcagtgcctggcccgccgctgcgtgccgctgccctgtccagagcctgtcctgctgccgggagagtgctgcccgcagtgcccagccgccccagcccccgccggctgcccacggcccggcgcggcccacgcccgccaccaggagtacttctccccgcccggcgatccctgccgccgctgcctctgcctcgacggctccgtgtcctgccagcggctgccctgcccgcccgcgccctgcgcgcacccgcgccaggggccttgctgcccctcctgcgacggctgcctgtaccaggggaaggagtttgccagcggggagcgcttcccatcgcccactgctgcctgccacctctgcctttgctgggagggcagcgtgagctgcgagcccaaggcatgtgcccctgcactgtgccccttccctgccaggggcgactgctgccctgactgtgatggctgtgagtacctgggggagtcctacctgagtaaccaggagttcccagacccccgagaaccctgcaacctgtgtacctgtcttggaggct

SEQ ID NO: 465189 - DNA, 2652 bp, Homo sapiens
tacgggttgctaagtccactagccattctacagtgtcagcggggatggcgaaggtggggtccctgtgtcctgggaaggacagggatgggtgggaggtgtgtaggctgccatgtgacagcccccttactacagcctgtgagctggatggagaggagtttgctgagggagtccagtgggagcctgatggtcggccctgcaccgcctgcgtctgtcaagatggggtacccaagtgcggggctgtgctctgccccccagccccctgccagcaccccacccagccccctggtgcctgctgccccagctgtgacagctgcacctaccacagccaagtgtatgccaatgggcagaacttcacggatgcagacagcccttgccatgcctgccactgtcaggatggaactgtgacatgctccttggttgactgccctcccacgacctgtgccaggccccagagtggaccaggccagtgttgccccaggtgcccagtaactactgccccccgccccaccacgctagggcccccacccccctaccccccagcttccaagtgggcacttgtgtggcggctctggactccagggctggagggactgtcaggctttgccctcatacctgcccccaccatccactgcccagactgcatcctggaggaagaggtgtttgtggacggcgagagcttctcccacccccgagacccctgccaggagtgccgatgccaggaaggccatgcccactgccagcctcgcccctgccccagggccccctgtgcccacccgctgcctgggacctgctgcccgaacgactgcagcggctgtgcctttggcgggaaagagtaccccagcggagcggacttcccccacccctctgacccctgccgtctgtgtcgctgtctgagcggcaacgtgcagtgcctggcccgccgctgcgtgccgctgccctgtccagagcctgtcctgctgccgggagagtgctgcccgcagtgcccagccgccccagcccccgccggctgcccacggcccggcgcggcccacgcccgccaccaggagtacttctccccgcccggcgatccctgccgccgctgcctctgcctcgacggctccgtgtcctgccagcggctgccctgcccgcccgcgccctgcgcgcacccgcgccaggggccttgctgcccctcctgcgacggctgcctgtaccaggggaaggagtttgccagcggggagcgcttcccatcgcccactgctgcctgccacctctgcctttgctgggagggcagcgtgagctgcgagcccaaggcatgtgcccctgcactgtgccccttccctgccaggggcgactgctgccctgactgtgatggtgagggtcatgggatagggagctgccggggtgggatgcgggagaccagagggctgggtcagaataatctttactgccctagggtggatctaaaatatttattacagtaagaaaaagccccgaggctgggagccctagctgaagcctgtgaccccgacaatttgggaggctgaggcaggaggatcacttgagcccaggagttcaagaccagcctgggcaacatagagagatcttgtctctacacaaaaaatttaaaatcagctggtcgtggtgcctcttgtagttccatctactccggaggctgaggtgggaggattgcccaggagtttgaggctacagtgaaccgtgttttcaccactgcactccaggctgggtgacagagtgagaccttgtctcaaaaaaaaaaaaaaaaaaaaaaaaaagcctgacactaaagcctggatcttctcctgcctctgttgctatttgccgtgtggtcttgggcaagttacatagcctctctgggcctaaatttggctcttgtaaaaagacccagtcccccagtccccctgtcttccctcactcttgtgcgatcttggccattttggccacttgcccttaccaactgtaattttatttactatttgccttccaattaactcacttattaatttaatttgatttagaaaggagttttatatcacactgatgccgctaccatggcgtcactactgcctccggagagacccttcctgacccacttgaccctacctgctccctctgcacctgccaggctggccaggtcagctgtgtgcggctgcagtgcccaccccttccctgcaagctccaggtcaccgagcgggggagctgctgccctcgctgcagaggctgcctggctcatggggaagagcaccccgaaggcagtagatgggtgccccccgacagtgcctgctcctcctgtgtgtgtcacgagggcgtcgtcacctgtgcacgcatccagtgcatcagctcttgcgcccagccccgccaagggccccatgactgctgtcctcaatgctctgactgtgagcatgagggccggaagtacgagcctggggagagcttccagcctggggcagacccctgtgaagtgtgcatctgcgagccacagcctgaggggcctcccagccttcgctgtcaccggcggcagtgtcccagcctggtgggctgcccccccagccagctcctgccccctgggccccagcactgctgtcccacctgtgccggtgagtccagggatgtgggggtagatgagatatgaggttagggctgccaccccctgcc

SEQ ID NO: 465190 - DNA, 2883 bp, Homo sapiens
  misc_feature (1754)..(1756): n is a, c, g, or t
  misc_feature (1762)..(1762): n is a, c, g, or t
gtgatagcgctgggcgactccgcggagctgcacggccatggacgtgggcgccgacgagttcgaggagagcctccctctgctgcaggagctcgtccaggaggccgacttcgtgggtgaagagcctgggattcgcggctgtgccggacagagccccttgccccgggcgagcttgaggagggggtggcgggacggttgccaggccacagggcctcagagagggcctcgggaaggacaggggggcttccttctccagccccggggcggtgggactttgagcagcaagtacactccgagccccacgtcccttgttggccagagccccgtgcgcccaggtgcctggctgctccttgccttggttcctccattttcccttcctgacctcacttggcttcttgagcgcagaggtctggacatagagttcacgggccttcgttctaacctgtctgggccccagcagatcaggtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgaggggcccttagtgggacataatatgatgatggacctgctgcacctccatgagaagttcttcagacccctcccagaaagctacgatcaatttaagcagaatatccacagcctatttcctgttctcattgataccaagagtgtaacaaaggatatctggaaggagatgaatttcccgagggtgtcgaatctttcggaagtctatgaagtcctgaacaggggcacccagagccgccagtctgtccccagtcagcaggacgaggcacgagaggccatcgaccccgtgcccgagtcatcctttcctcagtaccttgacgtgctggctccttacgtgaaccaagtgaacctcatccgagcgggggtcccaaagatcaatttttctggtccagattatcccagtatccgacctcccatcctcatcctcagcgtcaaaaggtggcctggggtcagcgagcagcaagtctaccataagtttcagaatctctgcaagtttgatgtcaggcgactcacaagaagccagttcttactcctgaccaataagtttaaggatgcgcggaacatcctgaaggagtaccgggaccacccgaccctgtgcatctccctgtaccgctactggaggcactccccaaacgtcaactgcctgctccagctttcgagcacgtgctttccatcgttctcgcccctgctgcccggggcccagccagtcattagggctccctggcttccctctcactcctccatggccctgggtggtgcagctcctctggacgctctccccaagtctctggtcactctcttctcgattgccctcaactcttcccctggccctttagatgttggtgttcaaggacctggcaccatccgccgtgacagtgccgggccccagcatgactctgaagtttgtttgnnnctgctnctcagtttttggcggtttaccctgagggggttacgaggatgctgctggtggtggtggacgagaggcaggagccggcgctggggccgggtggtctgcagactctcgtcctctcctgcgcctcctcacaggtcaccaacattcccaggatcgtggccctgttcctccatcttcagcagcagcaatgtggaatctctctgatcgatctttctgctgtgggcactgggcatctttggggagccattattctgcctgccacattctccagcgacacactgatgaagcacctgcccagggagctgcccaaaccttcctcgctgctgaggccgtgtcctcagcccagtggagcagcagcagtggccactgcctgcgtgaccctgctgagacctgtgctcgtagtcagatgggatgttctgaactcctggaagccagaggtggaagggctgtctggcttcctgcacacccctacagctcactctggatacctcttgtagcctctctgtgaatgtcacatgagggaccctggtgaggctgccatgtcaactacctgagttctagaaagaccaaccaggtgacagaggccaaacattttacaatcctgtaaagttaggtgttcactttttgaaaactgataagatgcaaataattcttgtccaataacaacgaaaatagttcttgctcataggagaggataaccccaaaacctgtggttttattgtcctataggacactaatcagtctatatgtagctttgcaatttccctctagcattctctttgttgtttttgttcacttaccagttcacacttcagtctctcacctcccctttaaactggttcccatcgttattgcgaggcctggaggcacctatcttcattctcactccttccctgcccaatgccagggatccagcaacagacaaaaacccaagttttcctaactctttcctggctcctttttcctccacctgaagtggaggtgctgcaggtgctgcctgagaagccaagaggcctggaggagaggaggagggaaagcagctttgttgaataggacagacttgcaaatctttcctgttttatttttagcttaaaagccaataactgatttctttgtttctctggttc

SEQ ID NO: 465191 - DNA, 1110 bp, Homo sapiens
acacactctcctcctctgaaaactagctaggggttcgaacttgcttgtgctgcccttctcgaatgactcgcgtttcctgctttcatcactacacctcccaccgctctccatcacctgctctgctcttataaggatccagttttcagaaaaatggaatagtcgtatcactgatctacgtaaacaagttgaagaattgtctgaaagaaaatacagtgtgtctaaactggaaaagtcctgtaatagtttgttcatgagcatttacacaatggagttgctgtttcatcatgggggtactgtggacaaacccagggctgctggtgagtcatgccatccttacacgtctttccttgtaaggtactttgtagtgtctgtctaaatattagaaagtttctttgtttctagattacttgaaagctaaggaaaagttgtagttctctaattatcaattagcatttcttttatactttcagtgtggatatttgggatttctttatatatttattgcaaagccctagatcttagggatttgactgaaaaaaatatatatatatgcgtgtatatacacacgcgtatatatatacgcgcgtatatacacacgtgtccttagccgagatgtctcaccccactctctatgatgcaacaagaagcccctggggaacgtttcagtcccagtctgtactattgtcatgtgctcatcacagtctggatgtctttttgtcacttccagctggatctaccatgaaagacgtcagagtccaggaagagagactgactgggcaacatgttattcagagagaagatcttgatctgtggcccaggctgcagtacagtgacatgatcatggttcactacagcttcaaactcctggcctcaagccatcctcccacaatctcactctcgcccagagtggagtgcagtggtgtgatctcagctgcctgcagccttcacctcccaggttcaagcgattctcctgcctcagcctcttgagtagctgggattacagaagcaggaccttgctctgtcacccaggatggagttcagtagtccaatcatggctcattgtaacctcagatttccaggctcaagcaatcctcccacttcatccttccc

SEQ ID NO: 465192 - DNA, 4319 bp, Homo sapiens
tcagaggtttgatccttttggcgggacagcgaagactggcgtttccgccgctgaggggctgaggccgggagggcgcagcgtagccgtcccgagctgatgacgtcaaacgccgtgtgctcacccacgtgtggtgcccctctcccggtgtaggcgctggagctgaggacgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggtttctgtgctgatccctctcttggagaatggagagctcttgattcctggccgaggtgactgtctgaaagtggcacctggatttcagttttttgcaaccaggagactcttgagctgtggaggaaattggtatcgaccgctaaacagtcatgctactttgctagacaaatattggaccaaaattcacctggataacctggataagagagaactgaatgaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggtaaaatcttacctcctacaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctgggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcagggtgtgtgggcttttttctcgctgccccgaacttgatacaggcataggcattgatgacattttggtctaacttccttaactttcaaagagctttattcttattcattggccaactgaacaattacttacaaaagtcagtactataactttttcctggtagaaaactttgtttctagttgtgcaactttggagggagcactatggatgcagatgattttatctatctttaaagttatcttttgttattttgctgataaataccacagattattcagtaaatggctaaaagttctacttacagtttcttacaaatgttgccagcatagttggaattgctttccttagtattttttgaggaataatgtttacaaagatacttctcagtgtataggaataaaaatgttcttctgcttcttgcattttccagaaatgtaaaaaggggaaaaaaaaggaaaaaaaaatgctcttttaatgatgctgttaaatgatgtcgtcattcttttaaaaaaaaaaaaccaaaataatacttggccaggtgcagtggctcatgcctgtaatcccagcactgtgggaggccaaggcggtcggatcacttgagcccagggttttgagaacagcctgggcaacacggcaagactctgtctctgcaaaaaatacaaaatttagctgggcttggtggtgcatgtctgtagtcccagctactcaagaggctgaggtgggaggatcacttgagcctgggaggtcgaggctgcagtgagctatgattgcaccaccatacttcagcctgggcaacagagtgaaaccctttgtcaaacaaaacaaaccaatactcagttctggtttctcagctttgtaattttttgttgttttaagttgcttaattggctaatcttttacagaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggacctttctgcctccataaagtcctgggggattttgggtggcaaaa

SEQ ID NO: 465193 - DNA, 1685 bp, Homo sapiens
tcatccagttttaatgttgaaagtatgcagaacaagacagcttgttcaacaagtggctgttttcctactttatgcccttctctgaaagaatgtacaactgtgggttattccttgaacttctgtgtctttcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcagggtgtgtgggcttttttctcgctgccccgaacttgatacaggcataggcattgatgacattttggtctaacttccttaactttcaaagagctttattcttattcattggccaactgaacaattacttacaaaagtcagtactataactttttcctggtagaaaactttgtttctagttgtgcaactttggagggagcactatggatgcagatgattttatctatctttaaagttatcttttgttattttgctgataaataccacagattattcagtaaatggctaaaagttctacttacagtttcttacaaatgttgccagcatagttggaattgctttccttagtattttttgaggaataatgtttacaaagatacttctcagtgtataggaataaaaatgttcttctgcttcttgcattttccagaaatgtaaaaaggggaaaaaaaaggaaaaaaaaatgctcttttaatgatgctgttaaatgatgtcgtcattcttttaaaaaaaaaaaaccaaaataatacttggccaggtgcagtggctcatgcctgtaatcccagcactgtgggaggccaaggcggtcggatcacttgagcccagggttttgagaacagcctgggcaacacggcaagactctgtctctgcaaaaaatacaaaatttagctgggcttggtggtgcatgtctgtagtcccagctactcaagaggctgaggtgggaggatcacttgagcctgggaggtcgaggctgcagtgagctatgattgcaccaccatacttcagcctgggcaacagagtgaaaccctttgtcaaacaaaacaaaccaatactcagttctggtttctcagctttgtaattttttgttgttttaagttgcttaattggctaatcttttacagaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggacctttctgcctccataaagtcctgggggattttgggtggcaaaa

SEQ ID NO: 465194 - DNA, 785 bp, Homo sapiens
actggatatgagcttaatggatgggttcatgggaaggaaggaatagggatgcatatgccaggttgcctgtgctttccagttagtcagatcagcccataatacctcttaccagatttaccttgcccttttaaattaaatattttactttttattttaaaatttttatttttaattatacatagagacagggtgtcactgtgttcccactctggtctcgaactcctgggctcaagctgtcctcctgccttggcctcccaaagtgctgagattacaggcatgaaccaccgtgcctggcctacccttccctttatctaccaccttactatatttaaaagttgggaagcagcatcacccaagaggttaaattttgttctggaaataagtttggttgtattgcagaaggttatttagcattatgcatatttgtcttttctttctagggtttttgtttgggtttcttaacacagcttgacagggcatcacacccaatagttcagaagctcatctgtcaacacattgtccctggcaatgtcaagagtctgctgaagcaggtatgttcttttgttatttttgacttgttacacttgaaaggctgaattaccaaattttcagctgtttggttttttttttttcacataactttttaattataaaggtaatctgttgcaaaaagtttaaacattacagaaacatatgtttagatggtgaaagtttccaataagcgtgctctttggagatttaaatactgtggataatctttccagataaattgtataatgtatata

SEQ ID NO: 465195 - DNA, 4929 bp, Homo sapiens
tcagaggtttgatccttttggcgggacagcgaagactggcgtttccgccgctgaggggctgaggccgggagggcgcagcgtagccgtcccgagctgatgacgtcaaacgccgtgtgctcacccacgtgtggtgcccctctcccggtgtaggcgctggagctgaggacgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggtttctgtgctgatccctctcttggagaatggagagctcttgattcctggccgaggtgactgtctgaaagtggcacctggatttcagttttttgcaaccaggagactcttgagctgtggaggaaattggtatcgaccgctaaacagtcatgctactttgctagacaaatattggaccaaaattcacctggataacctggataagagagaactgaatgaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggtaaaatcttacctcctacaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctgggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcagggtgtgtgggcttttttctcgctgccccgaacttgatacaggcataggcattgatgacattttggtctaacttccttaactttcaaagagctttattcttattcattggccaactgaacaattacttacaaaagtcagtactataactttttcctggtagaaaactttgtttctagttgtgcaactttggagggagcactatggatgcagatgattttatctatctttaaagttatcttttgttattttgctgataaataccacagattattcagtaaatggctaaaagttctacttacagtttcttacaaatgttgccagcatagttggaattgctttccttagtattttttgaggaataatgtttacaaagatacttctcagtgtataggaataaaaatgttcttctgcttcttgcattttccagaaatgtaaaaaggggaaaaaaaaggaaaaaaaaatgctcttttaatgatgctgttaaatgatgtcgtcattcttttaaaaaaaaaaaaccaaaataatacttggccaggtgcagtggctcatgcctgtaatcccagcactgtgggaggccaaggcggtcggatcacttgagcccagggttttgagaacagcctgggcaacacggcaagactctgtctctgcaaaaaatacaaaatttagctgggcttggtggtgcatgtctgtagtcccagctactcaagaggctgaggtgggaggatcacttgagcctgggaggtcgaggctgcagtgagctatgattgcaccaccatacttcagcctgggcaacagagtgaaaccctttgtcaaacaaaacaaaccaatactcagttctggtttctcagctttgtaattttttgttgttttaagttgcttaattggctaatcttttacagaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcaggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtaaagatctgtgacagtgactcatgagggttcatttcaattccataggattacttgagttatcactgaagaactcatgaaagtattaatccccccttctttcctccttcctcttttttcttttttttttttttttttaagaagagactaagagtgggtcgggggctgggggagggatagcattaggagaaatacctaatgtaaatcacgagttgaggggtgcagcaaaccaacatggcacatgtatacctatgtaataagcctgcacattctgcacatgtaccctaaaaaaaaaaaaaagaaa

SEQ ID NO: 465196 - DNA, 2219 bp, Homo sapiens
tatgaggacaaaaagagaaaagatcgaaaatacttatgttcgattgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcagggtgtgtgggcttttttctcgctgccccgaacttgatacaggcataggcattgatgacattttggtctaacttccttaactttcaaagagctttattcttattcattggccaactgaacaattacttacaaaagtcagtactataactttttcctggtagaaaactttgtttctagttgtgcaactttggagggagcactatggatgcagatgattttatctatctttaaagttatcttttgttattttgctgataaataccacagattattcagtaaatggctaaaagttctacttacagtttcttacaaatgttgccagcatagttggaattgctttccttagtattttttgaggaataatgtttacaaagatacttctcagtgtataggaataaaaatgttcttctgcttcttgcattttccagaaatgtaaaaaggggaaaaaaaaggaaaaaaaaatgctcttttaatgatgctgttaaatgatgtcgtcattcttttaaaaaaaaaaaaccaaaataatacttggccaggtgcagtggctcatgcctgtaatcccagcactgtgggaggccaaggcggtcggatcacttgagcccagggttttgagaacagcctgggcaacacggcaagactctgtctctgcaaaaaatacaaaatttagctgggcttggtggtgcatgtctgtagtcccagctactcaagaggctgaggtgggaggatcacttgagcctgggaggtcgaggctgcagtgagctatgattgcaccaccatacttcagcctgggcaacagagtgaaaccctttgtcaaacaaaacaaaccaatactcagttctggtttctcagctttgtaattttttgttgttttaagttgcttaattggctaatcttttacagaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggacctttctgcctccataaagtcctgggggattttgggtggcaaaa

SEQ ID NO: 465197 - DNA, 1696 bp, Homo sapiens
cagccttaagggtcaaagattgaactcagaatttgagatttccaggaggatgatcaagatgagcttcgattgacctgcaactagcccagtgccagccacatagtagcccattacttgcaacaaatgtaccacactgatgcaaaacaatgataggggacaccgctggggtaggaagcatatggaaactctctgtgctttctgctcgatttttctgtagacctaaaactattcttaaaaaagaagactgctcttcctctcagtcccaaattgaactcaatttggaaaaggcgagcggtggaggtaattttggctgtggtgaaaactttggtggaagaggaggctatgatggaggtgctggaagcagagatagttgcagaggaggtgatggtgaatataatggatttggaagtgatggtggcaactatggtggtggtcttggttatagtaaaataaggggctatggtggtggtggaccaggacatgaaaaccaaggtggtggatatggtggcaatggtggaggatgtgatggttgcaatgaaggaggaaattttgacagtggtaactatgatggtggtgggaagtatagtgattttggaaattatagtggacaacagcaatcaaattatggacccatgaaaggaggctttctgggtggaagaagctcgggcagtccctatggtggtgattatggatctggtggtaaaagtggtggatataataacagaaggttctaaaaagcagcaaaaaagggcttcagttcctagcaggagttaaaatgcacagaattgtgttaaccataaactttgggtgtttatatgccatcatccttgatccattcacaataccattcaataatataataaacatccaacccaacaatcagaataattttgccatggtaacacctgtggggcattcctttttgaacagtaccccttcccttgatgtctgcaatatcacctttcttatagattagcatatatgtggccaaaggaacaactccatgtttttgtaaaggcctagagaacatatatccagtgcctttcctttttgcctttgtattcatcattttggcaaattactggaagatgacggttctggccaaaaggctggttttgtttttgggtcacattttcttgcttctctgcgttagaatcttggattagatgatggacatggtgaagatggaaaatatgaggtgcagagaagtgatggaaaaaagagaagatcaggatttcagtttttttctgcatttctcatcatcccatgaagtctcttgataacataagccaagttttcatataccttgacgtgtgtgatacttacgtggtgccaagaacaagatgcatactcaataaatattcatcactataggcaaaagcgggcacagatggaaaataaaattatttgaagagtcttgctctgtcacacaggctggagcgtagtggcatgatctcagctcattgcaacctctgcctcctgggttcaagcaatcctcctacctcagcctcctgagtagcttggaccacaggagacaaaatcctactagagagaaggggcctgcttcaagcacataactggattctacctcaagacaatctgccacatttgaagcttggaatcttcaaagagcagaatagaatgtgctgtactctttcaggactaaagagacaaagacttctagggtctcaatcga

SEQ ID NO: 465198 - DNA, 1423 bp, Homo sapiens
agcacactcatgcacacacttatgacgaatgtgagagtacacggagtagctttggtccccctttctctgactgatcatgaggctgtcgttgatgttttgagggactctcagctgtggcctctccgaatgcattcacctcttctgaggcatcagagccagccagttgccatctgttctcagcagccagccccacacatctctacgggcaggacagcccattgcacatccactactccttggagtaaaagaacatgtccccagcagaacaatgtggtgctttccataagcacgggaaaacctgcctcctggtgctcccagctgcttcacgatggaagatcccacacatcacagccaacagaatcccttctgctggtctttggagaaggagagaactgctacgatgccctacctcaacccttcctccgccctccacagctcctcctgcatcccccacccccaccaccaaccaccagaaggcctcttgaggccctgtgcctatgatctgcctggccttctgcttttcttttgatctgttaaattacactttttatttatacctacaacaaagctgagaaggtggggggagcgggaatgtctttttgctggcttttgatgctttcaaaacaaagtcatggagaaaatagtggctatcatttattgttactgttttattatcaaaacacttggccacgacttggctcttgccggtgacaggggctgagtgggagccatgctgagacatcagctctgtgaaggaagccgtgtcacctagctggcccatatctcaacacaggttccttctccccttggagacaggacctggtagaaagctcaggtcatgtgtgccagggaacgctttgtcacaccaaggccacctaatggttccttcacaagcgcctcacactttcagatccaggtatgtttgtggtgtgtcttcctttgcagatgctgtctggaaagtgaagagaaggctaatcaaggaccgatctggatagaaagggacacacacggaccaagcgtctaattgggggttgcccaggtctcactggtgcctggcttcccttggagcatttccattgcagttcacagtcaatccaagaatcagcgaaattctcattttcttttttccaggtcttccaagagctacagagtcgaacagaagctgcatctatctggcgtgcaggctgtcacctgtgacagagaggaaaggcaggatggggacaaagaccaggatctcactatcagtttaggaaattctctggtcttcatgctggcttctgacccttgtgtcgccgagtttccgtgagtgccagcagtttcaattacaggtttacaaagctaagatcttcaggaagcctccggtcctttcactaactcatgactgttacaacaaagagcacgtgacagtgtcttctagacactc

SEQ ID NO: 465199 - DNA, 1208 bp, Homo sapiens
agcacactcatgcacacacttatgacgaatgtgagagtacacggagtagctttggtccccctttctctgactgatcatgaggctgtcgttgatgttttgagggactctcagctgtggcctctccgaatgcattcacctcttctgaggcatcagagccagccagttgccatctgttctcagcagccagccccacacatctctacgggcaggacagcccattgcacatccactactccttggagtaaaagaacatgtccccagcagaacaatgtggtgctttccataagcacgggaaaacctgcctcctggtgctcccagctgcttcacgatggaagatcccacacatcacagccaacagaatcccttctgctggtctttggagaaggagagaactgctacgatgccctacctcaacccttcctccgccctccacagctcctcctgcatcccccacccccaccaccaaccaccagaaggcctcttgaggccctgtgcctatgatctgcctggccttctgcttttcttttgatctgttaaattacactttttatttatacctacaacaaagctgagaaggtggggggagcgggaatgtctttttgctggcttttgatgctttcaaaacaaagtcatggagaaaatagtggctatcatttattgttactgttttattatcaaaacacttggccacgacttggctcttgccggtgacaggggctgagtgggagccatgctgagacatcagctctgtgaaggaagccgtgtcacctagctggcccatatctcaacacaggttccttctccccttggagacaggacctggtagaaagctcaggtcatgtgtgccagggaacgctttgtcacaccaaggccacctaatggttccttcacaagcgcctcacactttcagatccaggtcttccaagagctacagagtcgaacagaagctgcatctatctggcgtgcaggctgtcacctgtgacagagaggaaaggcaggatggggacaaagaccaggatctcactatcagtttaggaaattctctggtcttcatgctggcttctgacccttgtgtcgccgagtttccgtgagtgccagcagtttcaattacaggtttacaaagctaagatcttcaggaagcctccggtcctttcactaactcatgactgttacaacaaagagcacgtgacagtgtcttctagacactc

SEQ ID NO: 465200 - DNA, 1160 bp, Homo sapiens
tatttgcaaatcactgcaccaatttctgtgttgtagttggtttttgagtctccagcttcacctctcaactcctgccactttatggaacaccctcagtgcccaggggtctcttgtccttggtcctggttctccctgggctgccttgagactttgcagtgtgccaataagaggatgtatatgagacccttactcatgtatttttctcttgtgaagctgatcacactggacttttaagtcctttcttcctgacattcagtctttgactctgaattagctgaggcatgagaagttcaccacaggaaggtcctgccctttgtttgctcctaaaggttcctttaaagttcaacttgaccaacacaccattgcaagcactccagaggagaagacagccttgctgtgtcaaatccactttagtttgtaaatttcttgtcagtcacttttatgcccccactgaataggacagtgtgaagcatggattaagtatgcaataaatggttgttgaataaatcagaaaattaaatgcattctgcacagaatatgctatttctcacctttgttcccaaagctattctctctgatctacaggcaggccaaatgatctctgttctatcagaatctaacccaactagccccagagtccactggaaggagtgggaaggggatgccagaaagcctgggcatgcaggggaagttgtgcctgctgaagtctgcctgctggggctgtatagtgttactgctgtgaaaaagtcccccagtatggagccccttactgtgggccccattgtgaggttcatccagaggaacaaggtgaccaggcaataccattttcagggaacagacccagaaatgtcacacactttgtttaatatcaagaaaacagtgcttcttcgaaccaggattattgatttagatgctcgaaaggtcagagctggagagcaaacatatttctatgggaaggaggcagtgccttcctcttctaatcatagatcatgtccaccttggcaagttcagggcctttcacgggattttattgttgggaatccaaagaaaacacagttgagagtaaggtctcagagggtggcttgtcaagatgaatgtctgcaccattttcctcttacaactatgcctatgtacaaagtgtatcacagaggtaagtgact

SEQ ID NO: 465201 - DNA, 2294 bp, Homo sapiens
  misc_feature (1)..(1): n is a, c, g, or t
  misc_feature (4)..(4): n is a, c, g, or t
  misc_feature (7)..(7): n is a, c, g, or t
  misc_feature (9)..(9): n is a, c, g, or t
nctnctnanatgacaccggcaaagcgtgacaaagcgtgacagacagcgctgctctccccgactgtctttctcctccgctccttctgcatctccccaacgcatctcatcgccaccctcacctccacctccctccctcggcctgtctctttcttctttatcaagccacgagtggcctcagatgcggttacaaacctactggggctggcaggccatggagacggtctatgacgccaaccccaggctctgcgaggacgtggtcatcacggacgaggcctcaggtcacagcacagcccggcacggccatgccaccgccgcggcgctgagtcccgtcctgtgcagggagcctcaatgggctggcggctgggagattccctctcttcttaaagcaaagagccacttggccgagggcaggcaggtccagaccttgggcggtggggctggctttgagcaggggcaggcccctgggggtgccgctgtgcagccgggaagagggtgtgaggcccagagagtgtttgctgctctgcaggcacgtcccagtgtctcaccccagaggccatcgggacccgcggattccctcagggagggcgcctggcctggctgtggcaccggaggaagtgcagccccgctgaccatgctgtttacacctgagctgaacccgcaggctgctccctaccaggcactggcctcctgcccatccctggctgcaagggcagaggctcctgagagacctgtttccttcttcctcctcagccagtgcctgccttcatggagctttgcagacgctcggtgcgaggggagcatgtgtgcacagacggacgctgggtacgaggtgagcgtgtgcacggacggacgctgggtgcgaggtgagcgtgtgcacggacggacgctgggtgcgagcgtgtgtgcacggacggacgctgggtgcgaggtgagcgtgtgcacggacggacgctgggtgcgaggtgagcgtgtgtgcacggacggacgctgggtgcgaggtgagcgtgtgtgcacggacggacgctgggtgcgaggtgagcgtgtgtgcacggacggacgctgggtgcgaggtgagcgtgtgtgcacggacggacgctgggtgcgaggtgagcctgtgtgcatggatggacgctggttgcgaggtgagtgtgtgtgcatggacactgggtgcgagggatctgtcagcatgaaggtggggatggatgtccaaggctgtgaatgtggctcctgggggcgggcccagcagatgccagaatcaaggcagagtctttagaggaagaatacaaatagcctggggctggctggaattttctcccgtgcagtcgtccagcctcccgtggcagggagcggcatctcagtgtgcgaagccctttgtatacttccctggaatgtggcttttattttgtaacaaagcaaatgttttactgctggttttcctttaacaaataaatattggctccaacacatgtcagagaaagtcgacaacaataaacccaagtgtctgtgattaatgaaggagaaaatgatcctccccactcttcccctcccaaaacataggtcccaagatgggattttcagccgtggacccctccagagcctgggtgggttctgtacttttgggtggttgagttttttctctggcctggggaagccccatcctggagtcctttatctgctgtttcccacctgtcaagtggggttggaatccgataatgggagaaatggcccctctgcgctctaaggaagggctctgcgtggtgctagtacctgctttcatatctgtgtttttaaaaacacaaggccaaagtgttgattctcccaggagatttatggtatcagccaacccctgggcactgtggggctggggtagcccttccaagtagcccccataagagcaggggccttatggacctttatacactgtatccttccctattggcttatttaggggaggaaaacctttatcactcccctcaggttctgttcctgaggtttgcaaattaaactgacaaaaggcagatttgcagcagaaaagatagcagaaaattaaatttaaatttgaatgttatgtgcacggaagcttcacagacaagaagcaaaaacccaaagaagggatgagacacggggacttatataccattttaacaaagggtgataaattgtggagaaggacaaaggaaaaagggggtttgggctcctaggggtggtagattgttggcggtgattaaaaaatgcatgggagcaccttctgctctctctcaccccacaggtctgagtctgaaccccaaggaccc

SEQ ID NO: 465202 - DNA, 264 bp, Homo sapiens
tgtttgtttgttaatgaagattgcttcttcctttcgagtctttagaggaagaatacaaatagcctggggctggctggaattttctcccgtgcagtcgtccagcctcccgtggcagggagcggcatctcagtgtgcgaagccctttgtatacttccctggaatgtggcttttattttgtaacaaagcaaatgttttactgctggttttcctttaacaaataaatattggctccaacacatgtcagagaaagtcgacaacaataaa

SEQ ID NO: 465203 - DNA, 369 bp, Homo sapiens
  misc_feature (59)..(59): n is a, c, g, or t
  misc_feature (335)..(335): n is a, c, g, or t
cacacaatgtcctacctaccccccttctgtcacaaccgccccgcttactttgaaagcanaaccaattacctggggctggctggaattttctcccgtgcagtcgtccagcctcccgtggcagggagcggcatctcagtgtgcgaagccctttgtatacttccctggaatgtggcttttattttgtaacaaagcaaatgttttactgctggttttcctttaacaaataaatattggctccaacacatgtcagagaaagtcgacaacaataaaaaaaaataaaacaaaatgagcctcgtttggccctcagcaggaggaagctctgccggcacgtcttnccctttagcagagaggctaacttcatagactcct

SEQ ID NO: 465204 - DNA, 257 bp, Homo sapiens
tcacaagaaaattttcggatattaccaggcccctgctgtacacgagatccaagtacctggggctggctggaattttctcccgtgcagtcgtccagcctcccgtggcagggagcggcatctcagtgtgcgaagccctttgtatacttccctggaatgtggcttttattttgtaacaaagcaaatgttttactgctggttttcctttaacaaataaatattggctccaacacatgtcagagaaagtcgacaacaataaa

SEQ ID NO: 465205 - DNA, 367 bp, Homo sapiens
gcccatcatagtcctcattcccccgccccgacacacaaacctaacctcaggatctgtcagcatgaaggtggggatggatgtccaaggctgtgaatgtggctcctgggggcgggcccagcagatgccagaatcaaggcagagtctttagaggaagaatacaaatagcctggggctggctggaattttctcccgtgcagtcgtccagcctcccgtggcagggagcggcatctcagtgtgcgaagccctttgtatacttccctggaatgtggcttttattttgtaacaaagcaaatgttttactgctggttttcctttaacaaataaatattggctccaacacatgtcagagaaagtcgacaacaataaa

SEQ ID NO: 465206 - DNA, 414 bp, Homo sapiens
gcccatcatagtcctcattcccccgccccgacacacaaacctaacctcaggatctgtcagcatgaaggtggggatggatgtccaaggctgtgaatgtggctcctgggggcgggcccagcagatgccagaatcaaggcagaggtgaggggttggctcaggtcttttggatctgaggggctcagggaggtgcaatcagggaaatcaagtcagcccctggacagaggagttcagagaaggagcagggacagcaccccggatggggagggcgtgcgctgtgaccagggagcagcagagacaaaggtgcaaaccaagcctgatacccagggggctggggaggaggttccgaggagagtgggacgggttcctgtggctggctcggggccaccgtggccctgatgggagcggctctggaca

SEQ ID NO: 465207 - DNA, 1599 bp, Homo sapiens
cgtatggtggaaatgctacatcatgttgcgctactgcacatctcttcccaccttcacattatcgctcggtagttcctcctgtgttcacttctcttttctgccgccttatgaagaagattccttgcttccccttcaccttccaccattatttagcagaggaacactgagtaaagaagaacaagaagcagaagtggaggaagcagaaaacaagaggcaggaaacaagaggtctggaaaggaaaaagctccctggacctctcacaaggatgtcagccagagctcaactaacgctagattctactgcaagatgtgaagggaagcaacgcagctcttacacagtcaacaagtgtcctttctgcagtctatgtattgccacattcttcatatttttgtgctttttgctggggatttcactttttaaaatgctacccccggccagataatcggcattctgaaagtgtctgaagatatcatgtatgatagacaccaaagagtgaccctgtgcatttcactcctgaattactggttggcagaaatggctgagcaacacaaacagatctgagaaggacaaaacagataaattcagaaaacagagctggactaaattggtctaactaggacacttgaaggcttgtgaatcagttcacacgatcagtgtgaaaagcgggtatgaagacccagatgctggtgtgtacgtgtgcatataagccccaacagctagaaatcaagcctttctggcttccgattgttggagaagtggaaacagttaatggagtatgcaatgagttctggcggtcagaagtccaaaatgggtcttacacgactaaaatccagatgtcgacagggaggaagaactgaggatcctacatcatgttagggagcagcaagagcactgtagtaagacataaccctcctttgcctctctatgtcctctgccccatgctgcttatgtccttattgaagttaagagtccggctgtcattgagaacctctgatactgcaccatttgatgaagggctatgaaaaattcccccgagaacagcaatgcacactgatcctaccagctcattcactagaatacactttctaaagccaatactaatggctgtaggcaaatagagcaggacggtcaagatacctctacccacttcattctacgcatagactgtctggttctctgaggtcacagcagtataatcttaaggtgaccattaagatctgattgacacattttcaggatttaaagtaaaattaaaagaacgtggaaggcagctgtttgtggcactgtaacagatagccatgtttacgaaaacaaattcaagttgagcaatgatctggcagattttgtttgccagggaggaccattgagccaatgggacccacaattttcccacttcaagagattttttttttctcaatgacattatataactgattcagatatcatttttcctttacatacccagacacaaccctagagatgccgagcccccagatatttcactttttatcagatatttggcacaaagaaacacttctgcagtctatagtttaaactatacaactgtctgggaaaactttgtgattgtaggtgctaatt

SEQ ID NO: 465208 - DNA, 1159 bp, Homo sapiens
gaacatcggactccaagttctccagcttttggactcttggacctacaccagtggtttgccaggggctctcgagtctttggccacagactaaaagctgcactgccagtttccctacttttgaggttttgggactcagactggcttccttgttcctcagtttgcaggcagcctatggtgggacttctccttgtgattgtgtctctttatggcatggatgtggagggtaaatttgaagcctcaccaaacagcttcctgctcctggagcctggaccattccttggggacctccaagaagagtctgtgcctggggactgctcctcacagccctacctcccgttctattttagagccgggacactggtgactttcctggggaaatctctagatgtgacctctatggccggggacaggggactgggtttgagtcttgagtcctttccagcaagcgccttcccgcttggagccttgtttccttcctggataaatgggcggggaagcatcacggaggtgtgcgggtttaatcggcacatgcgctgctgcctgcaggccaagctcaggataagctcttgcagtaaatagcaacgtttatgtccctcgactcctggctcagagacgcgacccagaatctggcaaccatacccgccccttagctggcccccctccactgatgactaatggccaggtgtaagacagtcttccgaaggggccgtaagaccaccatgggctcaagatagacattgagtcctgccctcgcccacctcctcctctctccacctccacatcttggtttcttgtcctccgtgtgcaaaatgtgctttcctgccccacctacgtctccacatatgaagaatcaataacaattttagagagaaaatacagttgtcatggaaaaaaaatggagtgaattcagagttcattaggcaagttaatcaaattgtccagccgtgtcttgctatttctgggaaccatctggcccgcctgatcgatgtgattccaggtgggaagtgtttgggagtgagggtaaccgtgacttctctgaggtcacagcacggagatgccaggtaaccggatgggagggcttggcatgtccctgggaggcactgggaatgcattgtcccatgcctgggcaggggcagctttggctgggaccctccattgg

SEQ ID NO: 465209 - DNA, 1375 bp, Homo sapiens
ccctcaaaagttttttcgaagccctttggaattatcacgggtggataatccagggatttttgtggccataagggcctatcccgattaaatgctaacgccagcaggggtttgacccaacagttttggaacttaagcgcaaggacttctcttatttacccccgttaccagaagcgggaaataaatgatatctttcattctatcggcaagaacacaagactggttattgtgaaaggaggaggcgtcattcctgcggaagccctatcccacatgacgaacgacaaggccaggggcaagcaaaaagaggaaggactctcttgctctgctccgacttggccagtagaggcagtgaggagctaaagatcattccttctttccttccttcactctccgtagacagctctgcagggaagtctgtgacaacctggccagacatagggctcacgatctgatcagagtcatggcaccccagactctgctgcctgtcctggttctctgtgtgctgctgctgcaggcccagggaggataccgtgacaagaagaggatgcagaaaacacagctatccccagaaatcaaagtctgccagcagcaacctaaactatatctatgcaaacacttatgtgaatctcaccgagattgtcaagcaaataacatatgctgttctacctactgtgggaatgtttgcatgagcatcctgtgagtgggagagtgggctgggatgtgcatcctgcttcccaactcctctatccaagactgtgcccacatccgaagcacaaggacctcaagtcaccagcataagaacatcaacaggaatgccgccctctctactgtctgaaccccttgtccctgtcaaataaaccagaacaaatgcccagggatcctacctcttttgctgccactacagatgatcattgagagctcactgtggcccctacagatgccccacttgtcttgcgtcctggttctagtgcttcttgctgggccattcaatgaaagagacatcagagaagaaaacttccttcatcagaccagaggctgtgagccacctctgaggcatcaccgggctctgggtatctcaggcttgtcttcacctttctcaagagcttcccttggacaaggaggtcttaggaaagagatcatgatcaaccatcaacacagacaccatcagatgtactctgtgggctgtaagggcatgatctccaagagaccttatttggtgtttccttggatagcctcccttaccaagcatcctctcaagccacccccaaacatgcctactagacactacaggcatatcttgttttattgagccttgctctattgcacttcacagctatagcgtttcatacaaattgaaggtttgtggcaactctgcatc

SEQ ID NO: 465210 - DNA, 915 bp, Homo sapiens
ccctcaaaagttttttcgaagccctttggaattatcacgggtggataatccagggatttttgtggccataagggcctatcccgattaaatgctaacgccagcaggggtttgacccaacagttttggaacttaagcgcaaggacttctcttatttacccccgttaccagaagcgggaaataaatgatatctttcattctatcggcaagaacacaagactggttattgtgaaaggaggaggcgtcattcctgcggaagccctatcccacatgacgaacgacaaggccaggggcaagcaaaaagaggaaggactctcttgctctgctccgacttggccagtagaggcagtgaggagctaaagatcattccttctttccttccttcactctccgtagacagctctgcagggaagtctgtgacaacctggccagacatagggctcacgatctgatcagagtcatggcaccccagactctgctgcctgtcctggttctctgtgtgctgctgctgcaggcccagggaggataccgtgacaagaagaggatgcagaaaacacagctatccccagaaatcaaagtctgccagcagcaacctaaactatatctatgcaaacacttatgtgaatctcaccgagattgtcaagcaaataacatatgctgttctacctactgtgggaatgtttgcatgagcatcctgtgagtgggagagtgggctgggatgtgcatcctgcttcccaactcctctatccaagactgtgcccacatccgaagcacaaggacctcaagtcaccagcataagaacatcaacaggaatgccgccctctctactgtctgaaccccttgtccctgtcaaataaaccagaacaaagccgagcgtccgaaacacaccccctaccgcaacccccgacaccctaaacg

SEQ ID NO: 465211 - DNA, 3702 bp, Homo sapiens
acaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatggtaggtggtttatgaaagaacatagacatgtaacatgtgtaactgtattaagttactagagaactcttttacagtacatgcaatatgacttgaaatttattgtgcagttaagctaatggtggtgacttcatgatggtgggtttgggggtacacgtgaaggtttgctttatagatccaaagttcattagtgcccacctcatctcagagagtgacaatcctgaagatgacaaagtatactttttcttccgtgaaaatgcaatagatggagaacactctggaaaagctactcacgctagaataggtcagatatgcaagaatgactttggagggcacagaagtctggtgaataaatggacaacattcctcaaagctcgtctgatttgctcagtgccaggtccaaatggcattgacactcattttgatgaactgcaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaacttgtcccagcaaaacatttggtggttttgactctacaaaggaccttcctgatgatgttataacctttgcaagaagtcatccagccatgtacaatccagtgtttcctatgaacaatcgcccaatagtgatcaaaacggatgtaaattatcaatttacacaaattgtcgtagaccgagtggatgcagaagatggacagtatgatgttatgtttatcggaacagatgttgggaccgttcttaaagtagtttcaattcctaaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacaatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggctttttttcctaataccaccacctaacagagaacacaggtgaatgcagatgttcactttagcagacttaatgtttcctatgagatttcactgtacaggtttgtctttcttctttgcctgagaaataaaaatgtcatttgccatattgccatctaaaggagaaaaactgcatcagcaaagccattgtattgaactaaaagtttaaaatgaactgcatggatttactaagctgatgaatattccaaaacgtggttggattcaaggatatattttgtctaccggccctcatgtttgtatgtacttgaggagtaaaatgagtaaaatgatactgaatgaaatgttctgtggaaatattaaaaaaaaaaaaaaacataagccatccatcatccagaagaaaaatggaatacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattccgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggaaggatggaataaagacatcttattccttcttcactttcaacggtggtgaaattcacaatcgacaattcacaaactcaaaatcaaaagacataaaggagtaagctatttcagctaatgatttgaatcagtctgacaagtgatggtgatagctctataaaatgagtaacaggtcagtattagtgtgcaggctaaaacagtcaagcc

SEQ ID NO: 465212 - DNA, 487 bp, Homo sapiens
acaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatgatccaaagttcattagtgcccacctcatctcagagagtgacaatcctgaagatgacaaagtatactttttcttccgtgaaaatgcaatagatggagaacactctggaaaagctactcacgctagaataggtcagatatgcaaggtgaggtaaagaaaaaaaaactgagaaggatgtcattttcccataacagctttgctttttaaaattttctacctgtgtgcatatacaataaaaattatggctaaagcttgactcacataaaaataa

SEQ ID NO: 465213 - DNA, 4161 bp, Homo sapiens
gcactgaccctgtcctcctggctgctggtgacccctgactccctgcctcctgactgctggtgagcatgctgagtctgtttagaggggcgactcggggagttcctgaatgcaaagtgaggggtggttcaggccacacacctgtgagtgccctgggtaccagcccgcggcccagagcctggctcaggagctcagctggggcgctcgcggagactgtgacaaggattcagcctctgggtgctttgcttgtcaaagaacagggaagaaggacggagccacctaagcctgtgcaggctggaagcgctggtaacgtgggccaggctgggtcccaagctctggggccccttgcagtgcccttgggtgttgctagggtcttggaaagagattgagttttaggagagagcaaagcgatgactgccaccaactcacctctgcttggcaatgaccagccagtccctgaagaggaagaggtgcctcctggtggtctcagggccctgggtcagcaccatggggctgtgaaggacaggctcagcgtgcttgaggggcaggcccagctgcagggacagctgctcgagggtcactgcggatgccaggctcttcctgagggcgggggagacggagtggggcctgctggtggcttcgcacagcgaaagtgccgccgggccctgctccatggagacctgatcttctctccccagaacttcacatgggaaatgatctacaacctgccgggtatcagctaccccactctggggtggcggtggctcggggagcccgtggttctgccgcagcagcggagcctccagcgccagtcggcctctgttcatggagaggctcagtgccttcatgggctccctggcagcggttcagtgtggtgggttttcacctacctggtgtgtggccgtgccttgcctaaaatcttgtccagtccagcagctggcactgaggagcagctctgagccaggttcctgagctgtgggaacaaacaaagcagggctgatcattgtcttgcttggtaggaaacggcagctgcacttaaggcactcatgtaaaaagtgtgttcctaaacaaaatggagaaaaccaaattgtctccttgttatcctctgctctgctgcactgcctggaagggacttacacctaaattcggaataaatacatttatcaacgaggtcccaactctcggaccattggtgaatggccagggatgcctgattagatgataacataagacagttccggcagaaaggggcgggctgtggacccttctgaagctccagtggttgaactactggattcaacttaaaacatcagtccatttttgcattaagtgaaagcagtagttgtgcaaatcattgtactcacactggccgaggaagcaccagggaccgaaaaggacagggtggaaatctccctccccagccctctcttagcctgcttggtgtgatcaggactcttgatttctgggtctccaatgcagtgactctaactctgaacattggctgtgtttccagcccctttcatgtgtggctatttgacaaccagtaagcaacactttgacttcatttctgcaaaataaagatcaccattgttttctcgactgtgtccagctgtgtttattttaaagtaccttgttttccattttattgagaatggctacagaactctgccatatgctctgcattaatgagagggcatctgttccatcccatcatctacttcctggctcagaccacctgcaacacactggtttggcatctagcgggttgtgcttgcagaacagcaggctggctccgtgcacctgctcagtggggctgggctttagcaacctgcattgaggctgctcttcttaacttttctctaacttgcttcatgaaagttaattctgctgggaccccacgaggcagcggagagcccactctgcccatgattggtgccctgggctggcacgcagagtttaatggaggagcccgggagagagggatgcctgagaaccagggatgtgggctggagcagtgccacctcctctaactcacccgcaagcccagccaaccggctaaaccttccccacagagcctcagtctccttatctgtaaaatggattacctggcacttgtccagtctttctgcagtcaacatcgcccagattccatgcagaaccctttgcagactcctgaggaggtacagacaaggagtgtccctgtcctcatggtgctacatgaaaagggatcaggacagcatagtgtgtcctctgtcttgagaagttcgcatccagctctgccatggaccagccatgctcatggattgcctctcattttgctacggacaggagacaggaaaatactgggtagaagagggcggttcccgacaaaggccccaacctcaagcctgaagacccacgaccctaaatgaggacagccatttctgattttgtgcccaaaaatttgccttttggcctgccacacccaacatcttgcccctatataaacccgagaccttagcgggcacacacacaatcagccaaatgttgggattagcagaccagtggaccagcggaccagcagaccagttaacggtggaacaacgcagcagagaaagagagaagaggagggatgtctgaatgccaaggggaattcggccgcgggcagttagaaaagtctggctgctgggcggcccgactctaggggaagaccaccttcccactccatcccctgttctggctccccatccatctccctgagagccacctctaccactcaataaaacctttcattcatcctttgagcccatatgtgatttgattctttcaggacgctcagcaagagctcagaatatagaaggttgtctcagtggtcccctgcccttgcgataaggcagagggtccattgagctgattaagacacaagcccagatggcaaatctgaaagagctttataatacacacccacttgggcttggggagtcacagacacccattcctagatgctgccgtggggccagagcccaaaagggctttccctggcctctgcacctgcccatctgcatgctccccccagggttttgagctgtaggcgagccacacccctgttgcgcgtcctgccaaggggaattggggaactctactgtttcagtttcatgttccccatatttgtctgttaggcagagactgcttttgagtaaatttcttacaactaacaaaagaaatacgttctactttaaattatatcataattctgtgccccaatggaaataaagtttccaaaggaacaacacttttataattttaaatgcattttaagaaaaacagttccatgggttgaggatgcaggaacgagtgattctgagggcaaggctgcagttctcaggcttggttagccgtttctatgaagtgagaattttggcctgagaacccaggttgaacctcagatgtgagtagataattccaaatctaggaaatgcaagtcggtttccttcagaggagttgggagagcaggtgacttcaacctccagctcagtaagtcagggacccgagacttttctgaggtgctcagggaaggtatttcacccagttctgcgggatggttgctgtgtgtgtggagggctgaggagcacctcccatggcttgccagtgccttgacaattggagtcaactcaagaaggaacgccagggctctgtacctctggaaacttggcagtgagagatgagcagagacattcctgagctgtcatttggcaacagttccccatggagcatggccttgctctgaaatcagcctgtgtctccagtgagaaagcctctggcaaaatattgcttcatttcatgaagtcacagcctgggggatctttctcattccggaacaatctttctgaagcaccacaggctgattctatttcaatcagcaacaactggatttcgggcaaccacccaaggaaccctctttattgatatttcaggcctttaagttatattacagtcatattccggcagatatgatatgtatcaataagtcatgctacaacaggacaatgattttctaaatatgtgggaaatcttcactgattcatggaatcggggggtcgctgggttgaccttgtgccccaaaccatcagaagtgaagatgggtttgctaagtcagggtgtcaccagtgactgcctctctgttac

SEQ ID NO: 465214 - DNA, 2348 bp, Homo sapiens
atatgataagaaaagggcagggtgagaaatgatgcatctcagaatcaaaggctcagagaaacagaaattttacaaactcaggcaggaggagaggaaaatgggcccagcagagctgagaaacaaagcagaagagaaaaataactccagtacagaaatgaaagggacattggacaaaatgaaatggaaaatagatgttgatgcaaataaagtcaggaacatgaaagatgaccttgttagacccaggtggtttgctacagctgctgtgggggatgcagttgtggttccaaagtcaatggagttatgttcccaggagaattatggctgcctctgctgtgtcatgcagcttgtcagggaagtcggagaaagccggcagctacaggcctcaaccagctcctatgcaacccaaaaggctggtctcactcccaccatgcccccccgcaccccacctaatagcaaggaatttgcttccagacggtgggttagtgaggctaagaacttgccccaggccaccagagtccccgctgagaaagcaagcaaggcttttgcaccttcatgcctgttgagtctgcacactggattcttcttctggcagccctccccaaggacccctgtgagacaaatcaggaatggcttccctggggcccaaggagctgacagggcttttcctgctgcttcttctacccctgtatttcactcagctttctaaatgacccagttccaggccttttgtaaaagttctttctcatttatagtgcacctgcagaatgtcatctgtggttgtaacatagatatgacaggtctcaacttatttaaaaaaggatatggtgattcactggccagtagtataaaaaattggcctaccaattaaattcaagatagctttaagtctatttaatagacacagtataaatgaattactaccaaaatcttagaatattataccttaagtatgcactgactaactgtgccaggcaaaattaattcttatgtaattgaagccaacaggagtaaaacattggcaaaaagtcaatttgtgtgataaagagggagctaggcagtcccaaacagcttttagtgaatgcttttttgctttttttctatcgttgctgaagctaaatgagcaagagataaaagtcaaatatgtgcagactatattctccatgtcattctattctttttctgaaactaataaattggaccatgaggagtgttgctgaggctatatctttactcctcagaataaatgaaagaaaagacagaaaagcccctgagttcaggtcgatttgcacagccaaaaaaagtgtttctttttactgtattaatgattaaaattgcctctactgattaattatattgattaactttatagaaattcatctatcaaattcacaataggttgtgaattaaaatggaaaactcttggaataatgtaaatggactggatggacatggggcaactttaaatgcagataaatgagacttttttgctcacctggaacttcaaaaagtgcttaccagagactgtctcctcactgctatttcttatacacaaatttcttgttggcttcctgactcaatacttcaatttatagttatctggatttgctgtttgatgatttgaatgtgtcataaaatcacaaaattcgaaaggcaaaatcctagtaactggaataatcagagaagtatggcttctaggtctgtcacctctaattcatctcctcctcccccaagtgtgtaatcatagcctttagtttttacaaaactttcattactttaagtaaaaataagcaaatgtatacaagaacatttttatttctgtttcttatataaaggcaaacaaaataaaatgaggacaagaaaaacctaagagtttgctaatttcctgttaaagattaaaacacaatgtaagattaggaacatcaagttaaagttgtgacctgagatgacaaaccctaatcactgctctctgttatctcaacagtcaactgagtttggatacataaactaatatgaaatactttaggacatgcagaaaaaattttgaaaacagagaaagagaagcaacccaaggaaaaccaaacaagaaagcaaaataaaaaactgtcttgtgaaaaggccaaggccattattaagaagcacatgccagccgtcacccaggcctccttgcaagtttactgccttttattctacataaaatatgtaatggtttataactatttatggaaataatgcatgctaattttaacttatccatacaataaagtttgaaaacaaacaaaacctaaactctcaagccatcacttcgggttcacacagacatgtttgcagctcatttaatttccataggc

SEQ ID NO: 465215 - DNA, 1455 bp, Homo sapiens
gacaaggtttgtccagcagcaagtgaagaaattgacacatcaagactctttgagtggcatgatgggcctctggttcaggccatgaaggaggacggctttttcctcttggatgagatctcattggccgatgactctgtcttggaaagactcaacagtgtccttgaagtagaaaagtctctggtattagctgaaaaaggcagtccagaggacaaggatagtgaaatagagctgttgactgctgggaaaaaatttcgtattctagcaaccatgaaccctgggggtgactttggaaaaaaggagctgtctcctgccttaagaaaccggtttacagaaatatggtgccctcaaagcacaagccgtgaagatttaattcagatcatcagtcataatcttcgtccaggattgtgtctgggcagaatagatcctaaagggtctgacatacctgaagtgatgctggatttcattgactggctgacccaccaagagtttggcagaaagtgtgtggtcagtatcagagatatcctgtcctgggttaacttcatgaacaaaatgggggaggaagctgctttgaaaaggccagagatcatctccactgtgacatcttttgtccatgctgcatgcctggtgtacatagatggaataggttcaggggtaacttcctctgggtttggtacagcccttttggcacgaaaagaatgtctgaaatttctaatcaagaggcttgccaagatagtacgacttacagaatatcagaaaaatgagttgaagatttatgacagaatgaaggccaaagaattcactggaatagataacctttggggaattcatccattttttataccaaggggacctgtcctacacaggaataatattgcagactatgcactcagtgcagggaccactgctatgaatgcacagaggctcttaagagctaccaaactgaagaagcccattctcctggagggttcccctggtgttggcaagacaagtttggtgggagcattagcaaaggcttcaggaaatacccttgttagaatcaacttatcagagcaaacggacatcacagacctgtttggagcagatctacctgttgaaggtggcaagggaggagagtttgcctggcgtgatggccccttactggcagctttgaaggcaggccattgggtggtgttggatgaggtgaggggcctgtttgtcatgcccaagacggtgatcatgtgtgtgaggagcagtcatcctttcacagctccatttcacaatccatttctcagtggaagatcccgctgatgacttttctctaatgaaaagatcctctgtagttttctttaagaatgaggaaggtcacttggcagaatacacaaaaagaggcccttgtacataaaacctacaaactctcccactgtttaaagttatccttcagaggaaaactgcatcgtcactagtttagtctctgac

SEQ ID NO: 465216 - DNA, 2181 bp, Homo sapiens
ccagagtcagtgactccaaacagtttcttaacaaccatcagcccttccactctgcctatttgcctcttcgtttaatagcatctagagctctcagtaggtaggtgtccatttagctttcattttaaaagagccattgtggccgtgtggaagcatcgatcacttgggttctgaaatctcgcatgcagaagaacccaggtgtcaatactactcctgggaagtgtcaacccacttccactctgggtccctagacccatgtgttttaattaatcaggagcaaatttgtgtaaaaacacgtctggataaaaatcaatttagcaaaattgtttttaagatatttatacagataaaatgatataattatttcttagtctttcataatgaagccaacatttaacaataaattcaatattgcctttaaaaagccatttgtttagatatccaaagaatacccaatactatgttgaacaagaatgaatagaagaggaaaaaaatgaatgggtataataaggttgtcctggaaatctctatataggcaagaaaactataatttggaaaaaccatctatagaagatttcctggcagttctagaggaaagatatatggaggtttatggggacttcataggaagtattgcaggctgcataagacgcatggtgccagcatctccttctggggagagtttcaggaagtttccactcatggtggaaggtgaaggggagcaggcatcacatggcaagagggaggaagaaggagagaacatggaggaagaagaagaagaaaaaaggcagaaaaagggaagctctaatgttagggaagccagaagaattgaatccataaaccccaaaccacaacggatgaggactagaacacaatacatagtggtaaatgattcaacaggaagtgtgcttcacagggatgagttggatgaagccactagaggatatgtttttctaaatgaggaattaaaccaagaaagaggaagaataggagccaggcaacaggagagaggtaaagggaattcccagaacgacagcaggggaagtgccaggaccacagctgtgtagcaggcctagaagccaccagcccaggctggaggaggggggggtcaaggttctaagagtgtttgtatgtggggatcatatctccaaaaaagtactagaatacataaattatttgacctttgggaatattgtatagaaagatttataggcctcttacgctgtttgggaagacagagtattctcaatactaggcaaatgaaaagaaaaagaaattatcaactccaggaaaaacagaaagttgcatatgaatagaactataatcacaatgctctacctggtttaacagtaaacattatttcaataaagacaatataggatatgaattaaacattgagatataattttgtggggaaaatgaagagaggagaaaaaggggagtgtaaacaatgaaaatcttcatctatcattatgagaagacaataaataatgtcaaaaattggtgagttgtaaataaaatcaaggcattttatttaaaaatgataaagtaaatcccccccccaaaaaatatctacaacagttttatgttattacctctagaaagcatcacaaggttggaggaaggtggaagaacaaggagttattgtttcttgggttaagctttttagcatcatttgaattttcaaattattttcctgtgatatttgcgtaaacagttagatgtattttcaaaaaataagtgtattctttacaaaagttcaaagccttagacgtgtaatttgtgttcttttaacgttgatttgacaataaaacactgagctctattaatttgctgtctttattaacttatcccagttttttgggcccctatcaggccacagataaattcttgggagtcacagttttgcatgtttgtattattttcaattatacttgaaaatgcatatgcctgttttggatctgggtagccactgtgctttaaaatgtatacattttaaaatttatgtaactactgtaagcataaggaatttatcctattttcattttagtacatgtaggttcaaataataatataatccttcaaataatttccacattatttaaattattctgttaagtgagtctatacattatttaaatttgaaaagcactgacttgtttatatttactaagagatgtgatc

SEQ ID NO: 465217 - DNA, 674 bp, Homo sapiens
gtgcttagaggatcccgatgctctctccgtggggcggggttgattagcacgtggagctcgggctgccgcctcaaggaacttgctgggacgctttgctgagcgtggcgagtctggcgtgaggggcgcgtggagggaaaggagggagactttgaaccgtcgactcgcacccccgcagacaagtgagcgagcttagagagcccgggcaatgctccgaaagcctctgacctcagtcttctcgtccgtttgaccttcctacaaggcctctagaattcccagcctgcgtcagaataggaagaaacttccaaggcccggagcagctgcctccaagaaaaaggctcccaactcccgggcatggttctaaggccttgggattggtttttaactctaaatatcatattgtagcccttgcagtttgctggagacccctagggaaagaacaaagcgtcctgccacggtgcaccagaggaaggtgccacggactgtgggtgcacgcgtgggacctttacaccccaacctatttctcagagaaaacccttcggggctgggccaggccacccttttcttttgactgagatgtgggtaatgtgtgcccagacttgacgttgtttattgtgcgacattgtgtacaaatgtcctttataaaagtaaaggccactcgcacccccttttacgct

SEQ ID NO: 465218 - DNA, 1735 bp, Homo sapiens
caagtccaggggcgaacggcgtcatggagcccataggggcgcggctaaaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcccggggccgagcgccgcggccgagcgtctgcagcggcagcgcgtgtgcctggagcgcgtgcagtgctcgacggcctcgggcgctgaggtgaagggctccggccgggtgctcagctgccctgggcccagggccgtgaccgtgcgctacacctttaccgagtggcgctccttcctggacgtgccggctgagctgcagcccgagccgctggagccacagcagccagaggcaccgtctggggcctccgagccagggtccggggatgccaagaaagagccaggcgccgagtgcttccacttctcgctgtgcctgcccccgggcctgcagcctgaggacgaagaggacgccgacgagcgcggcgtcgcggtccacttcgctgtctgctaccgctgcgcgcagggcgagtactgggacaacaacgcgggcgccaactacacgctgcgctacgcgcgccctgcggacgcgctctgagcctggagagtttcgaagagccgtggggcggggttgattagcacgtggagctcgggctgccgcctcaaggaacttgctgggacgctttgctgagcgtggcgagtctggcgtgaggggcgcgtggagggaaaggagggagactttgaaccgtcgactcgcacccccgcagacaagtgagcgagcttagagagcccgggcaatgctccgaaagcctctgacctcagtcttctcgtccgtttgaccttcctacaaggcctctagaattcccagcctgcgtcagaataggaagaaacttccaaggcccggagcagctgcctccaagaaaaaggctcccaactcccgggcatggttctaaggccttgggattggtttttaactctaaatatcatattgtagcccttgcagtttgctggagacccctagggaaagaacaaagcgtcctgccacggtgcaccagaggaaggtgccacggactgtgggtgcacgcgtgggacctttacaccccaacctatttctcagagaaaacccttcggggctgggccaggccacccttttcttttgactgagatgtgggtaatgtgtgcccagacttgacgttgtttattgtgcgacattgtgtacaaatgtcctttataaaagtaaaggccactcgcacccccttttacgct

SEQ ID NO: 465219 - DNA, 1518 bp, Homo sapiens
tacacctcagtgtttgcattgcctctctatagactggcagtgacccagccatttctggcaatgagacacagtatctcccattcattagaggacaggaaaataacgtgttcatcaaatggcctgacaccaatgacattgtctggggaaagggcctacgttgcctttcctgacttctttcgtaatagcacagctgcgtggtggaagaaagagatagaagagctctatgcaaaccctcgagagccagagaagagcttgaagtttgatggattgtggattgaaataactcaacatttcccctcagatttggaatctagggacaagggcctgagcagcaagactctgtgcatggagagtcagcagatcctgccggacagctcccccgtggagcactacaacgtgcacaacctgtacgggtggtcccagaccagacccacatacgaagctgtgcaggaggtgacaggacagcgaggggtcatcatcacccgctccacatttccctcttctggacgctggggaggacaccggttgggaaacaacacagctgcatgggaccagctggggaaatctatcattgattttagtgagtcagcgcctcatgaaattcccacctcatgctctcattatgcatcttctcagacaggagcagatatctgtgggttctttggagatgctgaatatgagatgtgtgttcgctggatgcaactgggggcattttatccattttccagaaaccacaacaacatcgggacaaggagacaagatcctgtggcctggaattcaacctttgagatgttgtccagaaaagtcctagagaccagatataccctgcttccttatctctatactctgatgcataaagctcacgttgagggcagcacagttgtccggccccttctccatgagtttacggatgacaggacaacatgggatatagaccgtcagttcatgttgggccctgctatcttaatcagccctgtgttggaaactagcacatttgagatctctgcttattttccgagagcccgttggtatgactatagcacgggaactagcagcacatcaacaggtcagaggaaaatcctgaaggctccccttgaccacatcaaccttcatgtcagaggaggctacatcctgccctggcaagagcctgctatgaacactcactccagtcgacaaaattttatgggattgattgttgctttggatgacaatgggacagctgaaggccaggtgttctgggatgatggacaaagcattggtgcctacaccaccaggaccctgggtttcaagcacaaaactgatggtgcctggaacaccagtgagacagaaccattcactcccctggaaagccagggagccgagtgcccttgctcagcggatcccaaccccacagagcccagcaagctaagatccacaggcttgaaatactcgccgccagcacagctgtctgaagttgacgtgggaagctcgagtttggtggagggaggggcatccgccattactgaggcttgagtaggc

SEQ ID NO: 465220 - DNA, 2697 bp, Homo sapiens
  misc_feature (2)..(3): n is a, c, g, or t
  misc_feature (6)..(6): n is a, c, g, or t
  misc_feature (9)..(10): n is a, c, g, or t
  misc_feature (12)..(12): n is a, c, g, or t
tnnttntanntngagatggggtctcgctatattgcccaggttggtcttgaactcctggcctcaagcagtccttcccccttggcctcccagactgctgagatgacagtcacgggccactgtgccaggcccctcatgccatgagactgcgtctctcagacctccaactgcagaaagcataattaacctttggcctcagctgctgtactctgaaattcatgactactgcatttgctcagagactacactttccatgggctgctcccagccaacagccaagcacatcagggatactaaggcaggctcattcctttgatagatgatattggatacaatgtctgaaagagtcaaaggcaagaatggtatgcaacatgtgcaattctagtctcaagtcaggtggttagcttctgaaaaaacataggcacagaatttttgttgagataggggagcacctgatatcatgcacagtgtgtgatttcagccatgtaaggccatgttacatattagtgtaaacctggatcagggcagaaataaaaaggttctcagccacaggaatcctggaaaccaggcattttcactgcttctctcaaggagatgaattacccactttctgattcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaaggccgttaaccagcgtaaagattggcttacctatggtcccatgcagggctgctcctgtgagcatggcagttgctctcagaagtggactgtgagtgtggtgggcaccatgagtgaccagtccagcacaatggttataggaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagactgctacaagagctggcagagggttgaggcaaagctgagtggctggagaaatgacccatttgaggtagccagtggggctagagtggagaatctttctccacccctttacttggagcgtatgggtgtcattacatgtgagatgcgtctcttgaagacaacagatggatgggtcttgtttctttatccaacttgccactctttgccttggtctgtgggctatgtacttaagtgtgtttttgtggtagcaggagagtgggtgctccagatgcctggcgcactgcctggacatggagcagagagggtcttgctgcactatgatctatacccaggaagcgtggggcagcttaggctgctgaaccagatgagagggtgctctgaatgcctggagatctgcctggttgtgaggcagagagggcctctccataccagactctctgcacaggaagagtggggcaggtcaagctgccgatccaggcttgtgacaggggagagcacaattccagcacctactgctgaagcactttccacagttctggatgtggaggccccctatccaactctggagcaggtgttccaatctctggcctgagactaaaatgcccatacagccatgctgcaggtcaccaaagaatggccgagattaaaaatggtgtcctgctctcagtctcagatctgggaaaatgcctgcagcatttcccagtgtctttccttcacagtgtctccaatcctctcctcaagttaactctcgggcttgggagaagcaaaatgctttcccttggcctgggttgcttggatccccagtggaaagaaagctttatttgccaggctaaacgataaattaacatcatgatttaggctaagcaaaaaactaatatcatttttttctttcagatctctataaaaatggactccaaagagctaactttgtaccattcatagcagtcttgaagggtctcctgatgtttcttttatatataatttccagattgtacatatgaggagggatagggaaaagtacatctccatcttcccagaagcagaagtcagcttatttaaggtccttgtctgctaattccatcatttctggttatgtttctatggtttgattttttccccctggttgtgagtcctattttcctgcttctttgcaagtcaataatttaggaacttagagccatattttatcatagaaacaaaaaaataaataggataacaataaaaagacagttgtgggcacaggaattttgtttcagctttctctcacacatttagaggaacagttaggtaaatgatgatgcagtcacatgaggggatataacagttatacggaatatttttcaaaagctttc

SEQ ID NO: 465221 - DNA, 913 bp, Homo sapiens
ccggtcggggagaaggggagggacttagaagatgggtcaataggtgcagcaaaccaccatggcacatgtttacctgtgtaacaaacctgcatatcctacacatgtgtcaaataaaataaaataaaataaataaaataaaataagtcatgaagaggctcccttacccaaggttccatatagagccaaacaattccttttgcttttttgttatgtgtagtggtgcagattaataaaatgagactatcctttattgtgctaaagccctatcattcagtgtttttaggaacaactctacaagtccattttggcttctgcatggagagaagtgtgctcttaccttgtcctgtggaaagggcggccagtgcataccaaccataccgacaaacacgttacaccttgggccctttttggagctattcaggaaagtcaatgggagctttgttgattccgattaaaccattgttgactgtgagcaaatttattgacctagttgcaatgaaataccctggcatattatgtcagcttccaactggccaacacacagatgccatgcttgctgctgacggctatcagacgtgtgccagttggcagcttcagccacaagccatagatcaaatggagatggagaaaacattgctctccattttgcctgctaagccagtcctgttctcaattcaagactggaacagcccaaaccaagttttggtatcaagacaaccagaaagaaatatcatccttctgtggcctcacgcagtgaaacttctgcgagtgacaaactttcccaaagaacccacggtagtctttgcatctatatacttatactaaagtttcccaaataattaataagcatttctcacccacaggttactcatcttagggcttaatttgtaaagcttcttgaaagctttggtat

SEQ ID NO: 465222 - DNA, 762 bp, Homo sapiens
gagacagagtgtctcactcttgcccactgcactccagcccgggcaactaagtgaagccaagaagatttctttctgaaacaagatactttcaataaaactgcaaagaagaaaaccaccacctcttaaagaagtacattggtgttctttattcactcaatctgtatcatgagacttcgggaaaacctggtggattaaataccctcctgcaacctcactgaaagtggcagaaaagggattaaaatggatatgagctgcaaggataaagagaactgcaaaggagaagagaacaataacaccttagaacaataaaatctcagaactggaaagcaaatggacgagctgaaattgttcacagtgtcctggaatcgtaggcacttggctggccttgccctgagctgccacagtccgaaagagaacttcgtttccgatagcagctttatgctgactttttccatgcccggctctctgatggacataatcagggtaatggtacctcatacaatgccaagcacacagggtaaacaacaggcatttgccagaggaaaaggtgaattagaaaatatacatctatctgctcatttggctgaagagaactataggaaggataaacaagaggctaatgtgattggttacctacaggatatgattggggatggaaaagaaggaaggagaaaaggaggaaaggaggaggaaaggaggaagggaagaaggaagaaaggaaagaaggaaggagacagagagaaaggaagaaagtagggagga

SEQ ID NO: 465223 - DNA, 1739 bp, Homo sapiens
aaataatagctgtttgtattttggctgctgcaggagccattttagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggaggtgaagcaatatttactgactcatttgactgctgcttttcttgcagcagtaaatactgtgtttacgtttctaagtccaagttaaattcctatacagatctgttgctcaagtcaaattgataaatgtgtgctgatttgcaacaaaactagtctagattcaagtcaaagaaaactatccaccaaagttaaggatcaaaccttataaactgacaactcataacggcgtgcatcttggtctgaatactaataaatagctagagtgagaggaatacgcacacaattcttttgtccctgctccctcaacccactgcaacccaaaaaggacatttcagaaggtcctaaagtttgaatgtaaaaaacaaaacaaatctaaaagtgagagaaagtaaacaaataaataattttatttatgtaaacttgggaatttctaagtattgtacctatagcaagaggaaggactgatggattttaatattaaacaaatctataatgctatatatcagaaaatgccacaaaccttaaccttaatgtgttattcttggaataaagactaaaccctgtaatagagcctacacagccctttgtgtctgttttctgatctattcccaaagtagtggtttttccttggccgagaat

SEQ ID NO: 465224 - DNA, 1052 bp, Homo sapiens
aaataatagctgtttgtattttggctgctgcaggagccattttagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttgtacgtctatttaaagtattctctgtatttgggttttatatgaataaaactttttttctcttgtga

SEQ ID NO: 465225 - DNA, 1817 bp, Homo sapiens
tggttcatgttgtggaggcgttgataccctcatgagaaattctgttacttccataaaagtcctgaagaaataaatatcttccttcaatagatgaaaatgaaaatacagaaaaaagagaagcagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggaggtgaagcaatatttactgactcatttgactgctgcttttcttgcagcagtaaatactgtgtttacgtttctaagtccaagttaaattcctatacagatctgttgctcaagtcaaattgataaatgtgtgctgatttgcaacaaaactagtctagattcaagtcaaagaaaactatccaccaaagttaaggatcaaaccttataaactgacaactcataacggcgtgcatcttggtctgaatactaataaatagctagagtgagaggaatacgcacacaattcttttgtccctgctccctcaacccactgcaacccaaaaaggacatttcagaaggtcctaaagtttgaatgtaaaaaacaaaacaaatctaaaagtgagagaaagtaaacaaataaataattttatttatgtaaacttgggaatttctaagtattgtacctatagcaagaggaaggactgatggattttaatattaaacaaatctataatgctatatatcagaaaatgccacaaaccttaaccttaatgtgttattcttggaataaagactaaaccctgtaatagagcctacacagccctttgtgtctgttttctgatctattcccaaagtagtggtttttccttggccgagaat

SEQ ID NO: 465226 - DNA, 1072 bp, Homo sapiens
ctagaggaccccgttcactttctacacactagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggaggtgaagcaatatttactgactcatttgactgctgcttttcttgcagcagtaaatactgtgtttacgtttctaagtccaagttaaattcctatacagatctgttgctcaagtcaaattgataaatgtgtgctgatttgcaacaaaactagtctagattcaagtcaaagaaaactatccaccaaagttaaggatcaaaccttataaactgacaactcataacggcgtgcatcttggtctgaatactaataaatagctagagtgagaggaatacgcacacaattcttttgtccctgctccctcaacccactgcaacccaaaaaggacatttcagaaggtcctaaagtttgaatgtaaaaaacaaaacaaatctaaaagtgagagaaagtaaacaaataaataattttatttatgtaaacttgggaatttctaagtattgtacctatagcaagaggaaggactgatggattttaatattaaacaaatctataatgctatatatcagaaaatgccacaaaccttaaccttaatgtgttattcttggaataaagactaaaccctgtaatagagcctacacagccctttgtgtctgttttctgatctattcccaaagtagtggtttttccttggccgagaat

SEQ ID NO: 465227 - DNA, 1741 bp, Homo sapiens
ttaaactaatacccgatttgctaatagcctaaaactttcctaaatagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggaggtgaagcaatatttactgactcatttgactgctgcttttcttgcagcagtaaatactgtgtttacgtttctaagtccaagttaaattcctatacagatctgttgctcaagtcaaattgataaatgtgtgctgatttgcaacaaaactagtctagattcaagtcaaagaaaactatccaccaaagttaaggatcaaaccttataaactgacaactcataacggcgtgcatcttggtctgaatactaataaatagctagagtgagaggaatacgcacacaattcttttgtccctgctccctcaacccactgcaacccaaaaaggacatttcagaaggtcctaaagtttgaatgtaaaaaacaaaacaaatctaaaagtgagagaaagtaaacaaataaataattttatttatgtaaacttgggaatttctaagtattgtacctatagcaagaggaaggactgatggattttaatattaaacaaatctataatgctatatatcagaaaatgccacaaaccttaaccttaatgtgttattcttggaataaagactaaaccctgtaatagagcctacacagccctttgtgtctgttttctgatctattcccaaagtagtggtttttccttggccgagaat

SEQ ID NO: 465228 - DNA, 1174 bp, Homo sapiens
aaataatagctgtttgtattttggctgctgcaggagccattttagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggagcctgatgaagacttgttcaatccagactatgtagaagttgatcgcatcttggaggtggcccacaccaagg

SEQ ID NO: 465229 - DNA, 1309 bp, Homo sapiens
aaggcaagtaaagcgcagaaaatacaatgaggacctggacttcaaagtggtggatgatgatggggaaacaattgctgttcttggagctggtcgaacatctgcactctcagcctctacactggcctggcaggcggagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggaggtgaagcaatatttactgactcatttgactgctgcttttcttgcagcagtaaatactgtgtttacgtttctaagtccaagttaaattcctatacagatctgttgctcaagtcaaattgataaatgtgtgctgatttgcaacaaaactagtctagattcaagtcaaagaaaactatccaccaaagttaaggatcaaaccttataaactgacaactcataacggcgtgcatcttggtctgaatactaataaatagctagagtgagaggaatacgcacacaattcttttgtccctgctccctcaacccactgcaacccaaaaaggacatttcagaaggtcctaaagtttgaatgtaaaaaacaaaacaaatctaaaagtgagagaaagtaaacaaataaataattttatttatgtaaacttgggaatttctaagtattgtacctatagcaagaggaaggactgatggattttaatattaaacaaatctataatgctatatatcagaaaatgccacaaaccttaaccttaatgtgttattcttggaataaagactaaaccctgtaatagagcctacacagccctttgtgtctgttttctgatctattcccaaagtagtggtttttccttggccgagaat

SEQ ID NO: 465230 - DNA, 2269 bp, Homo sapiens
agaagaatttaggatctagtctagtctgtcccctttctgctctgatcaagctggacaaaacgtcgtggggccacagcacagggggccaacgcaagctgggatcgtcagacgttaggaaatcccaaggaagaagagaaaggggacacattcgggagacgtcggcacacgctcgaagcagcggacaggcacctctctgtggacaaggcagactgggcggccgagattccgcatagatgcctgcttcctccacgacctccacgtgtggctggcccagtccgggtccccctcacctcctctgtctgtcttggtggcctcacgccgtgggctgtgatgccggctacgctgcttgggtggccaagggagatgatgcaaccacatcctgttggagcccagagaagtgcggatgcagcccggggctctttctttcctagaaccctgcctgggagtggcttccctgaactaaggacagagactttgtcttcgttgcctctcggcctgtgggcactgagcatacagagtaattggggaagttgcaaattgtgtgacctccggaataatggctgttacaatttttgcaaaggcagtttcacagggatgaggccaggacagagggcacagcccgctgggactccagggctgcccctgcaccccccatatcagctcagagaggcctggtgtccccgctgccaggggttgacacccactggtaccccctgtggagcagctgtgggcgggggctctgcagggagggtgtcgggggggccaggcctgttctgcctgaccccgctacctccatccggctgccttccatgagcagcagctgcctcccccccacacccttccttggtggccccgcccctctgatctccgtgagccaggatctcccccaggatccctatttcccacgggcttttggcaatgggctgctcaccccctccttcccctcctcctcattcatctgccatctgtgaaatgtggaggaggggcctgccctgtgccaggatctgtgccctagacacttccccagccaggcccaagggctgagcgtgaggctggcaggtctgcacttgaggtggatggtgagggtgccctcgcccacctgcagccattgtctgctgagtacctgtggtgcagatggggatggctgcaggggggtctcagctcacgcagtattgcggccatgggtgctggacattggtaggtctctctgagcagagcccgatggaagtgagaagggcgtgcgttaggggagcatttggagagggagccacgggtacagctgccctgcaagctccagcgcccatgggaaaaagggaccgagggggagaggggaggggatagggggaggggaaggggatggggcgtcggtggttgcttgggctcttagggtgggggtgatgcctgcagtcttggtgttgaagggaagaccagggaagagggaaggcaggaggcctgggagagaaagggaagagctgttgggtgctggcggagtggagcgggctcttgcatcactccatcccaggctccaccctgcctgcacctggaggcctccctcacctggctcctctgtgctccagacccctcccctttccaggtccaggattccccctgcccaaacagcactgaccaggcccccagggcctgtgcctgcagcccccagggacgggtgggcgtaaaaagattgcaggcgtgagtcaccgtgcccagacaaattaaggctcttgagacgaggtcatcctgggttatgcagatggaccctgaatccgacactagcacccgtgtggaaggaacgagagggagatttggggtccgcagaggcaaaccacaggaggacggagtcggagactggagcaccgcggccttgatcgggggacaccagggctgccggctgtgccagaaggggctgaggctggaccggattctctccgagttcccagaaggagccagtcctgccgacgccttgatgctggactctggcctccagaaatgtgcgaggacaaacatctgcggtttctaggccccgcctgtggtcctctgttgcagcagcctggacagtctggactgcctggacagcatgcagatgggctctgcccgcggctgcccacgagttcccaccgcccgcccgtccgtgggagagccagtcctcgtatgtgaagcgtacctgtatccctttactccgcgtacacaggtgcctttgtcacttctcctttgacctggctggcacatcttaccggtttctgcgctaacaatgagttgaaggaaatcttga

SEQ ID NO: 465231 - DNA, 445 bp, Homo sapiens
taggcggagtctcactcttgttgcccaggctggagtgcagtggcacgatctcggctcactgcaacctctgcctcctgggttcaagcaattctcctgcctcagcctcccaagtagctgggattacaggcacccaccaccacacccagctaatttttgtatttttagtagagatggggtttcactatgctggccaggctggtcttaaactcctgacctcaggcaacctgcctgccttggcctcccaaagtgctgggattgcaggcgtgagtcaccgtgcccagacaaattaaggctcttgagacgaggtcatcctgggttatgcagatggaccctgaatccgacactagcacccgtgtggaaggaacgagagggagatttggggtccgcagaggcaaaccacaggaggacggagtcggagactggagcaccgcggccttgatcgggg

SEQ ID NO: 465232 - DNA, 2180 bp, Homo sapiens
acagctcattgagaacgggccatgatgacaatggcagttttgtggaatagaaaggggggaaaggaggaattaatggcaaggggagatgtgtatcgatgctattttagcccaagtcaaattaaacctgtagaactgacaacacacattaatctcccattgcctccagtagctgtgcaaatgagctcctcgtttctttatacaaacaactgtcattttgacgttactactttggcaaaaaattctagcgatggcctgaccaatatttttggaaatttttcactaaagcagtcaatgacaactcaacatagtcaacaagtcaatgtcaactttgacattggtccattgattgccctttcttttcccagaaactctggagttaccacacaacccataccactatcaatgagaggccaccttctaactgcgaatggtggaccacaggaaaggcccagtagagcagaggagagtacagtggcataactattaagaaatttttaactctaaaatttaggaaatacagggaaaactcttctgtgtctgagaatacatagaaagaatatacataacaacaagttttgcttggtcgggtaattttcattccaaataaacttatcacaaaaaaactcagcttcccaaggtcattcccccgctgccagatacatacttatctctgaaagagtttggaagatggacctttcaattcctctacaattagtagctgagttacagagtaacctgccagcaatcctatcagcattcatcagactatttaaatagagcaaagtccacaaaaagttccactgaggacatgctgagcaaaggccggagccccagaagaaaacaagtacagactcagaggaaagctgccctggtcctgagtgtgactcccatggtccccgtggggtctgtgtggttggcaatgagctctgtgctgtcagctttcatgagggagctccctggctggttcctgttctttggggtcttcctccccatgactttgctgctgctcctcctcatcgcctacttcaggatcaaactgattgagggtaagtgtgaggccacacaaggaagaacttgggcatcctttcccacagcacatcttgaaatataccgatgcactgtcagtgttttctggccaggagaaacatatatatatatattttgtaggtacttctcaatcagtgttctctcaagttccttgatcaatttggccaagtttgatcctttccactgtgtggatcttgtgctgagatgtgaaggtctgctgtagggggccctcacgtgtagcacctcacagacatactgtgaatcagcaattttgacatatggttgcttgtctctctctctcaaggcaatagagtcacatatgtgaaaacattgttcatggtctgccttctttacatgacagatgtgtttatgtggccatgtgtgtgcatgtccgtgcgtgtgtatgcgcccgtgtgtgcacacacacaactttctcatccactgaacttctggtcagggaatgttccaaacattctgctgtcacagtctttgtaaatgtaaagccctgatagataaatacttgaccttggtgtaaacgttcccaggggattaatagtccttaaggtggaaaaaaaccaaaccaaacaaataactcaggaagccttaaggtgatttggaatggacattcgggtccttggattgacactgtttattctgctataattaaaattaatgaaactgggctgtaactagatagactatgtgttaatactgtgccaagtacacatgagattaatatcatcaaggttaataactattttagcaaaatcaacaaagaccagtcatatttcttaatttggatagtgtcatattaaaacaaatttgaaaaaccctcctctttgaacatctgtttatgtaataacatacatgaaggcatttcttggacttgccaagcttttgtggtaatcttagatcactaatgctataatatataacctaacagaagtgcaatgagggatatttcttcctaagatgagatttggaacataaagaaatcctaggagacacagacagtatgtcatggaatcaagtttttcatcacaacttactcaaatatgcccctagcctttcatttttcgtgtgtctcatttttatgaacagcccttttgctgaggggtcaagccatattctgc

SEQ ID NO: 465233 - DNA, 1493 bp, Homo sapiens
acagctcattgagaacgggccatgatgacaatggcagttttgtggaatagaaaggggggaaaggaggaattaatggcaaggggagatgtgtatcgatgctattttagcccaagtcaaattaaacctgtagaactgacaacacacattaatctcccattgcctccagtagctgtgcaaatgagctcctcgtttctttatacaaacaactgtcattttgacgttactactttggcaaaaaattctagcgatggcctgaccaatatttttggaaatttttcactaaagcagtcaatgacaactcaacatagtcaacaagtcaatgtcaactttgacattggtccattgattgccctttcttttcccagaaactctggagttaccacacaacccataccactatcaatgagaggccaccttctaactgcgaatggtggaccacaggaaaggcccagtagagcagaggagagtacagtggcataactattaagaaatttttaactctaaaatttaggaaatacagggaaaactcttctgtgtctgagaatacatagaaagaatatacataacaacaagttttgcttggtcgggtaattttcattccaaataaacttatcacaaaaaaactcagcttcccaaggtcattcccccgctgccagatacatacttatctctgaaagagtttggaagatggacctttcaattcctctacaattagtagctgagttacagagtaacctgccagcaatcctatcagcattcatcagactatttaaatagagcaaagtccacaaaaagttccactgaggacatgctgagcaaaggccggagccccagaagaaaacaagtacagactcagaggaaagctgccctggtcctgagtgtgactcccatggtccccgtggggtctgtgtggttggcaatgagctctgtgctgtcagctttcatgagggagctccctggctggttcctgttctttggggtcttcctccccatgactttgctgctgctcctcctcatcgcctacttcaggatcaaactgattgaggttaatgaagaactgtcccagaactgtgatcgccaacataatcccaaggatggctcttccctgtaccagagaatgaaatggacgtgaagttggggactttccaataactaaagcacaatgagtttctactggtcagcaagcaatggccaacagttcagctaataaagtaggttgataaactagaaccatagcaaaatagaaagaatactaagatactcattctgaaccatactgaaaagtggcagctattatctaaggggacttctcagagactcagtataacagcagctcttgaaaagtaccaagaatggatttcctgggtatatacactggacacattgtaactttttaacttttattgtgactgtgtctgctctaaacggcatatttaaaaaataaaattctgcagcatcttactacataatcccataggaacccctattattcc

SEQ ID NO: 465234 - DNA, 1928 bp, Homo sapiens
atctagaatggcagtctggccacaaccgctttgctgcactctgttgagttctgctcagtccaaactttccagcctctttagcactgtcagagaaaaactgactactgaagcctcagtaatggtggacaccccttcccttaccaagctcaatcatcccaggttgacttcagactgctgtgctggcaacgaccatagtccacttatgacactattaaaaattgcccttttttcccaagctggtattggactcacagccaacaccttcctccttttcttctgtatctgcacactccctctggactgcaggcctaagcccactgacctcatcacctgtcacctggcccttgtccacttagtgatgctcctcactgtgagcttcttggcatctctggacctctttgagtcacagtattttcagaatgacttcaagtgtaaggtattcttctacatgcatagagggatgagggctctccatctgcaccacctgcctccggagtgtgctccaggctgtcaccattacccccggcacctcctggttggcaagaattaaacagaaattcacacattgcatctttcacttcttggggttctcagtttctttctcagtagtaacctgccttcctccactgtggcctcttctaatcttattttcttctgtgcttcatactttttatttattttttattttttacaataggatccggtttattctgccttggcagggtgatcctgagagtggtgggtgtcaccctctcctgggcagagggaggggccgtgggccagtcaagccaatggtaggagaagcgctggtgaggggtggaatttggggttcaggggtgtaaccccaagaatgcagtgaaaccaggccgaggcccagaggcagctgtggtaggccagggcagggtggaaggcagtggactgggcccgggccgggatgacagggccaaggactcaggccacactggcaccccgggaggcggggcgcagtgtcgcatgacgtagaaaatgaatcacaggcccagggctcacaataagcacatggacaagtgggcacagactcacaggccagatggacctccagccacggccgggccagactcgtggacacaggcgcagtgtcacgtacagaccacggggagacatggcactaggggacaaatggacgtgacaccacaatgcacagggcaggccacagagctcgagggacgtgggcaggggccttttggcatttctgcgctggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcatttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccgacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttatcatgaatggtatatattgttacagttgtaggtttatggacctgaat

SEQ ID NO: 465235 - DNA, 2324 bp, Homo sapiens
atctagaatggcagtctggccacaaccgctttgctgcactctgttgagttctgctcagtccaaactttccagcctctttagcactgtcagagaaaaactgactactgaagcctcagtaatggtggacaccccttcccttaccaagctcaatcatcccaggttgacttcagactgctgtgctggcaacgaccatagtccacttatgacactattaaaaattgcccttttttcccaagctggtattggactcacagccaacaccttcctccttttcttctgtatctgcacactccctctggactgcaggcctaagcccactgacctcatcacctgtcacctggcccttgtccacttagtgatgctcctcactgtgagcttcttggcatctctggacctctttgagtcacagtattttcagaatgacttcaagtgtaaggtattcttctacatgcatagagggatgagggctctccatctgcaccacctgcctccggagtgtgctccaggctgtcaccattacccccggcacctcctggttggcaagaattaaacagaaattcacacattgcatctttcacttcttggggttctcagtttctttctcagtagtaacctgccttcctccactgtggcctcttctaatcttattttcttctgtgcttcatactttttatttattttttattttttacaataggatccggtttattctgccttggcagggtgatcctgagagtggtgggtgtcaccctctcctgggcagagggaggggccgtgggccagtcaagccaatggtaggagaagcgctggtgaggggtggaatttggggttcaggggtgtaaccccaagaatgcagtgaaaccaggccgaggcccagaggcagctgtggtaggccagggcagggtggaaggcagtggactgggcccgggccgggatgacagggccaaggactcaggccacactggcaccccgggaggcggggcgcagtgtcgcatgacgtagaaaatgaatcacaggcccagggctcacaataagcacatggacaagtgggcacagactcacaggccagatggacctccagccacggccgggccagactcgtggacacaggcgcagtgtcacgtacagaccacggggagacatggcactaggggacaaatggacgtgacaccacaatgcacagggcaggccacagagctcgagggacgtgggcaggggccttttggcatttctgcgctggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcatttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactggcaccttaatttggttttaacacaaatgaagatctcactaaagataaaaa

SEQ ID NO: 465236 - DNA, 649 bp, Homo sapiens
cggagaaacccagaatgttcttccacatctgctcctggatccggtctgtgtcattttgcccggatcctgggcccgctcccaaggagggctcccccagctgcagggactcacttgctttgcagcagtgtggctatgttatgggcccacatccgaaatccacacagcccacaccacctgcaggacaagggcagccactcgaggaggaaaccggaagcggccatgaacccacgcctgggcagccacctggaaacgtggtcagatgtgacctcttcacagactcgggggtgctgggctctgagcagaagcggccgggtggtcctcctgggtgcctcaggggcccggggagcatgggtcagggcgagtggctgctccctggcctcaggttatctgggtgcccggtgagtgaggcatggcaggcgataccggaccccacccaccgcgtatacctctggaatagcgattgccatgattgatgtcagtagcctgggctgggagcctgcaggtaatcagaactgcgaagatgattgggtcacagccaggagactgattttgtatccagaagtttctgtttcacaatcactaaactactcatgctcaaagattagtgtcaacaagaaataaacagactctgataccgatataaaatgaa

SEQ ID NO: 465237 - DNA, 1962 bp, Homo sapiens
gtaaccggcggaaaactagggacgcgggcacagccgcagactgggcgtggggggcaccggaatggccgagcctgggacgctgggacctctggccgccgcggggcgaccaggcgggcggagacgtctcgcgccctcccgggccgcgcggctccaggcgcattcctgcacccagctcccgcgcgccgcgctgcgctgcctcccccggacagctgattcattggctcggccgcccagactgcctggcgccggctgcgtgacgtcacccattcacggagcccgcctcccccgctccgctggcgccggccgggcggtcgccctgacaacgcagacgccagcccgcacaatgacttccagctggagcagcccagccagcctgcgcgctcactcgcttgcttgcgctgggcttcagggcgcccgggtgagtttttttctctccctctcgtttttttttttttcccaggctctcgcgggtttcccctgccagggaatccactcgctgtagttttctagggctctggtcccagtcctttctgaagcgcgcttgcaggctgtcttcctcagtcgccctctccctgggtgctgttttgctgggcagcatcccatgctaggctcggcagacattctggcggttgggttcggcccttacagcgctaacacctgcagagtcgaggctcctgccaaaaggcagaaagcaaaggaggaaaaaattcattgtcataatagcgaaaatgataaacctcagctgtttaagagaagaatgtctgagtagctgttgattatctcccataatcacaaaacaacttttttttaaaaagaatttgcactgtctgttaaaacgcggtcattgttttgctttcaaatcgaacttcacgacagttagcaacttcaagaacgcttccaaatggataaatctttccagaagatttcttgcttcaaaacagctgcatttttggaagaaagtccacaactgacaactaagcaaaaccctcctggtggatagcataaatctgctttgttgaagctgctcatttgtctgatctatgagtccagaagatgcaaactcccttcccagcttatgcaaaaatacttccagtaaaaacaagccctttggcccttttcttttgtcagtccagatttcagcatgttcttcgctttgttattcatcattttatgtatttggacccatcctcaaacagactttaaaccgtttaaaggcaaggagggactctttcctaaacctttaatcccctggcccagctgagtagatgcacagtgtcttttgatgatggtgatatagaatgattaataaccacacaaggcattcggttggtcaagtcactgtttattggctcaaaataatccttggtttctgtatgtctacagctcacttcctaaacagttaaatccggagaagtctaatagataatagttggtgatcataaatataaataaccaatacattagaatgtgtagtcaaaataggaatacttgcttttcacttacttcccacgggtcgctgctggtggtagtcaacacaaataaaaatttgaactcattttgttattcatctaaaatgagaaactcggtgaaacattgattttctaaaattgctgcatatttaaatgtgattataattgctttttagcattttaaaattgtaacatcgataccaaatgcttaagaatctaaagaatagtctattggggctggcctattttgtgtaaaatggtttggttccagaccaccacaataaagcaaatatcatagtaaaacaagtcacacatttgttttttggtttctaaatgcacataaaggttacactataccatatatactcatattaagtttacactataccgtatatagtctattacactatgccatacatactctataagtttacactataccgtatatactctattaagtttatactataccatatatactctattaagtgtg

SEQ ID NO: 465238 - DNA, 1069 bp, Homo sapiens
cttatgcgtggggtgggcttcagggcgcgatttcttgcttcaaaacagctgcatttttggaagaaagtccacaactgacaactaagcaaaaccctcctggtggatagcataaatctgctttgttgaagctgctcatttgtctgatctatgagtccagaagatgcaaactcccttcccagcttatgcaaaaatacttccagtaaaaacaagccctttggcccttttcttttgtcagtccagatttcagcatgttcttcgctttgttattcatcattttatgtatttggacccatcctcaaacagactttaaaccgtttaaaggcaaggagggactctttcctaaacctttaatcccctggcccagctgagtagatgcacagtgtcttttgatgatggtgatatagaatgattaataaccacacaaggcattcggttggtcaagtcactgtttattggctcaaaataatccttggtttctgtatgtctacagctcacttcctaaacagttaaatccggagaagtctaatagataatagttggtgatcataaatataaataaccaatacattagaatgtgtagtcaaaataggaatacttgcttttcacttacttcccacgggtcgctgctggtggtagtcaacacaaataaaaatttgaactcattttgttattcatctaaaatgagaaactcggtgaaacattgattttctaaaattgctgcatatttaaatgtgattataattgctttttagcattttaaaattgtaacatcgataccaaatgcttaagaatctaaagaatagtctattggggctggcctattttgtgtaaaatggtttggttccagaccaccacaataaagcaaatatcatagtaaaacaagtcacacatttgttttttggtttctaaatgcacataaaggttacactataccatatatactcatattaagtttacactataccgtatatagtctattacactatgccatacatactctataagtttacactataccgtatatactctattaagtttatactataccatatatactctattaagtgtg

SEQ ID NO: 465239 - DNA, 861 bp, Homo sapiens
gtaaccggcggaaaactagggacgcgggcacagccgcagactgggcgtggggggcaccggaatggccgagcctgggacgctgggacctctggccgccgcggggcgaccaggcgggcggagacgtctcgcgccctcccgggccgcgcggctccaggcgcattcctgcacccagctcccgcgcgccgcgctgcgctgcctcccccggacagctgattcattggctcggccgcccagactgcctggcgccggctgcgtgacgtcacccattcacggagcccgcctcccccgctccgctggcgccggccgggcggtcgccctgacaacgcagacgccagcccgcacaatgacttccagctggagcagcccagccagcctgcgcgctcactcgcttgcttgcgctgggcttcagggcgcccggatttcttgcttcaaaacagctgcatttttggaagaaagtccacaactgacaactaagcaaaaccctcctggtggatagcataaatctgctttgttgaagctgctcatttgtctgatctatgagtccagaagatgcaaactcccttcccagcttatgcaaaaatacttccagtaaaaacaagccctttggcccttttcttttgtcagtccagatttcagcatgttcttcgctttgttattcatcattttatgtatttggacccatcctcaaacagactttaaaccgtttaaaggcaaggagggactctttcctaaacctttaatcccctggcccagctgagtagatgcacagtgtcttttgatgatggtgatatagaatgattaataaccacacaaggcaaaaaagaaaaaaaagtcgacgcggccgcgaatttagtagtagta

SEQ ID NO: 465240 - DNA, 669 bp, Homo sapiens
gcagcggcggcggcgttgttggctgaggggacccaggacacctgaatgcccctggccccagcttctctgacgcgatggggaaagtgctatgcaaaatcttcgggaacaaggaaatgtggatcctcatgttgcgcctggatgcggccggcaagacaacaatcctgacaagatccgcgctctcgcggcataactacactgggacccaaggtctgatcttcgtagtggactgtgccgactgccaccgcaccgatgaggcttgccaggagctgcaccacattatcaatgaccgggagatgagggatgccataatcctcatcttcaccaacaagcaggacctgcccgatgccatgaaaccccacaagatccaggagaaactgggcctgacctggattcaggacaggaactggtatgggcagccctcctgtgccacctcaggggacggactctgtgaggggctcacatggttaacctctaactacaaatcttaatgagcattctccacccatcccctggaaggagagaaatcaaaaacccattcacaggattatcgccaccatctcctctttcaattgccacttttcttttgaatttgaactctggagttactgttctacagtttggggggagagggcttgggggtcttctgtttcccgttctttttcctttttc

SEQ ID NO: 465241 - DNA, 1569 bp, Homo sapiens
agcggaggtactcgggacgctgaggcgggaggatcacatgagcccaggaggttgaggctgcagtgaggtatgatcgcgccactgcactcctgcctgggcaactgagcatgaaccctcctcaaagctaatggcgcttcaaaattctgcagtgcaaagaagttgctggggttgcggagcggagaaccgccaggaggctggagcccagccaggcagcctcctcgggcacacggtgaaggcgccggaactacagctacctccgcggcgccgcttcggccgccatatctgggtacacgggaaccgcagaggacaaactctcacccgcgttttcgatttctgcgctttcttcgagtgaggcaagacctagcagaggcccaagcccgtccctccctgccaggagcagcctcatgcggaccgagccgctgtgcggggcatcccctctgctggtgcccggcgacccctactctgtggtggttctgctgcagggctacgcggagccagagggtgtgggcgatgccgtgcgcgccgacggctccgtgaccctggtcctaccccagacccggggcccggcctccagccaccgagagtccccgcgcgggagtggcggcgcagaggccgccctggaggaggcggcccgtggccccatcctggtggacaccgggggcccctgggctcgggaggcgctgctgggggcgctggcggggcagggcgtggccccgggagacgtgacgctagtggtggggacccacgggcactcggatcacatcgggaacttggggctgttcccaggcgcggctctgctggtctcgcacgacttctgccttcccggaggccgctacctgccccacgggctgggtgaggggcagcccctgcgcctgggcccggggctcgaggtgtgggccacgccgggccacgggggccagcgcgacgtgagcgtggtggtggccggcacggctctgggcaccgtggtggtggcgggagatgtgtttgagcgagatggggacgaggattcgtggcaggcactgagtgaagaccccgcagcccaggagcggagccggaagagggtcctggtcgttgccgacgtggtcgtacctggtcacgggcccccctttcgagtgttaagggaagcctcgcagcccgagacggagggtggagggaacagccagcaggagccggtggtcggagacgaggagcccgccctgcactaatcagcctcgagagggactgcactcttgtcagggaagccctaacagcgaagagctgctggagacagagtcagagcagtcaagggtgggagcttccagcccttccaggaggccagttttctagtgaagacagagtgcacctgacactgccatcacatcgtcagtatcactgcctgtctctgccaccaaactaagatcaaaggaggggctcagctccctgtgcattctccctgggcctcagtaaaatgggagaaggttcgtgggaggggcctccaaaataaaaatggaaactgcattgaaaatcatagtgccctagtgtaaatgtgaagcattgacaatgataatcgtgcaaacatggtaatctaca

SEQ ID NO: 465242 - DNA, 225 bp, Homo sapiens
ctacagctacctccgcggcgccgcttcggccgccatatctgggtacacgggaaccgcagaggacaaactctcacccgcgttttcgatttctgcgctttcttcgagtgaggcaagacctagcagaggcccaaggtagagcgcggctaggattcgatggagggaaacataaaggatagcctttggagggtgacgggcaaggacgtacgtaccgcgaacggaatgggg

SEQ ID NO: 465243 - DNA, 1599 bp, Homo sapiens
agcaaaccacttcaggctctctaaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaagatcaaggaggcaaacaaattggctcaaataatgggaaacattggaggttcaggccaataagaagctccaacttgtaaacatgaagaaagtaagaagggaaaccctttggggattacaaagaatgatagagctaaaataaataaataaagcctaaatttatttttttaaaaacgatagaggcttgaggagatttacatgtcattttttggtgaactctgtggcagctgctgcc

SEQ ID NO: 465244 - DNA, 343 bp, Homo sapiens
agcaaaccacttcaggctctctaaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcatattgtgaaatattaaaataattccacaatagttgagaaaaa

SEQ ID NO: 465245 - DNA, 1825 bp, Homo sapiens
acattctgccccggctgacgccttccttgggccagtgctcgggggtgtgtaacaaacgccaagacgcattgtaaagaaggaagcctgcgtttccatcaccggcttaatatcaaacaaaagtgcaattttgaaaatgtagtccaaggttttctgtggtgcggaaatggccaggccagacctccgtgggtggtccttcgtgtccacgtcagcgccctacatccacactgtgggcaccatgacctcacatgcggagcggagcagggccggcgcccggagagccaggctggtcacgaacgaggcctagagggcgtcaggccccaaagcactcacaggcttctcctctgtcctcggggccttcagacacctgcatgcgccgattcagccacccgcgcgcgccgattcccctggccatggggtttccaaagtgtgtgctcagaggacagtttcctccaggatgacctgtcagtggctctctgtgccggggacgtcgcgtgctgggtcccggtctgaatgcttcctaacgatttacccagttccttttctccactcaggaggcgtttgctgagaggcacaggctgagcccccgtgctgatgccacgaccgagggaacgggtctccctgtcggcgtgaactgacccggccaggcgtccactgccactcggactgtctcccaggcacgtggcgcccacacgggcagaacacgccctccacacacgcggcttcgggcagaacacgaggcgccctccacacacgcggcttcggggcttgtcatgaaaaaagctgaatgctgggggtgcagctttcaccaacagaatcccgtttggaagggacgcgcctgcaggcctgcagaagctgcatctcgggatggccaagagcccggccaggccccacggctgcacccaggacgggattcatgccccatgcctggcttctcacgaccacagagtgcctttcccgggactggatggaggcagaagaagtgtccttggaggcttcacccacgcagacccacggcttcctggtagaagccgtctgcacccccgcactgacctggctctgtgaggagagcggggaggggctccagggaaacatcctggccccttcccaggaccctctgcgtgtccctggtcctcgcggcctgcatctgagcgaggccccctccatcctccctccagcctctcccaggaccctctgcatgtccctgggccgctgagtgaccaacctctcctcctgggggttcagctccctctggtttcagtccctccccacccagcggggacacggccactcacttccaggttcacaaagctgagtgaagtccaaacaggaaaagcccaaatagagccacactcagacacaccacaactcagacacatcacaactcggacacaccacaactcagacacaccacaactcagacacaccacaactcggacacaccacaactcggacacaccacaactcggacacaccacaactcggacacaccacaactcggacacaccacaactcggacacaccacaactcggaaacatcacaactgagacacaccacaactcagaaacaccacaactcagacacaccacaactcagacacatcacaactcagacacaccacaactcagacacaccacaactcagaaacatcacaactcagacacaccacaactcagacacaccacaactcagaaacatcacaacacagacacatcacacactcaagacacatcacaacctaacttctgaaaactaaagacaaaaatataaaagaacaacaattgaaatgactgcaaatttcccattagaaaccatggaagcagctgc

SEQ ID NO: 465246 - DNA, 693 bp, Homo sapiens
tcacatgcagtcccttctctggcacctccatacccctccgagatgggttctcagtcagcttcctcggcccctgacaacctgaacttgatccagtttccccctcctggctccctgcccagcccctgctgccgccctccaatggggcccactgagtcaagtgcaccgacagagaggcccgcattccgggaggtgcctgcgcagggaggagccagcatcaagtctcaaaaactcagtatttatgggagtcaaactgaagttcttagtaaaaatccagactctctgagcaagaagccccccagaaatttggattcagctgtgctagatgcctggtaccagcatctgcttctgatgatggcctatggctgcttccactcacagcagaaggtgaagcagggagatcaggctgatccagcacttgtccttgtaaaagccgaaaccctttccttgggatgcagcagccttatcacatgacctcggctggcctagcagagcagacctgcccaaaactgtgtaaatactgctggactggatggaacacaggatgtattagaatatttttcctgtatttaaatgtacacaagaaaggaagacatgctcatggattgacacatcttgagaaagacttgggagaaaaagacaaaacaaatgtgtcaaaaagagagaatgtaatacacaaccttgcttcatttgaaa

SEQ ID NO: 465247 - DNA, 612 bp, Homo sapiens
agtcaactgggaaattttgaatatggactgcaggttagattatattgaaatagcgagtttgttaggtgtgacaagggcactgaggacgcgtagaagaatgttgatacacaggcagaaatatgtgcagggagcctcgtggcatctgcaacttacaaatgtcccaacagcaaaaaaaaaagtgacagggagcgcattcggcaagacaccaacaattggtgaatccggatcctccctcctagagtctaagataagcagcatcaacagtccgtggtataaaagcagacaggaatggaagaatggagagacacctgtttgcaagaagagtgaagtcactgcaataaggaacacctactccaagcagcagcgaggagccctgacaccacaggtgctgcaggtgccccagagctgctgctgagctccgaacgtcaatgaatgacagtccagcatcccatgagcctgctgcggtgacctcctggatgttccacttctctgcagtgccatggggaaacccaagaactcaacatagagtgggatccaatctacgagccattcaggaaacacatagggagcagctaccattgtcaccagtgctgttccaggcaccgagggtgg

SEQ ID NO: 465248 - DNA, 724 bp, Homo sapiens
ctggagccgaggcacaaaaggtcaggccatgaaattccctgcaggagcccgggtcccaccattccactctcaggctctttggaaagctgactcccagggccacaagcaagtctttgtgtgtcaggagggcccactgctggggctttcagtgcacacaataactcacaggctgtgtccaatttcagaacacaacgaagaggcaatgaccacacccacgtgggcctgggctttcactcaggagttcggatctcatggaaaaacaccgtggaagatgccctggggcagcaccactacccggatccacatccactcaatcgccctagtagggcctccagagcactcctgcaagcgtcacgtggtttcacagatcccaggcagaggcagggcaagtgttactaccaccaccagtgaggaaatgaaagcccagagaagctgtgagacttgatgaaggtcaccaactggctaaatgatgataggtgctctaatgagaagttttattacctcactatattgttttactcaaaaatatttcctgtctgacagctgcttcccggatttactgcttaaacttttgaagataaagcaggaaataatcttctttgaacatacttgataaaaattccccaaaaaagcaaaaacacatgcttctactgcattgaaaaaaatttactgcagtgtggcacttaagagtaataacaaatagcaataaaaagtaatttcaaaa

SEQ ID NO: 465249 - DNA, 1003 bp, Homo sapiens
caaaggcttggctaatactgcaacgtttgggatccacagcctacaaaaccccacagctcctaagaattctctcacctgccttctgcccttaagctccggtagattgcaaataacctgctttctttctgttcctgagctgcgttcggacccctgtcgtattgtaaatcccacgcaaggtacctgccgtcggaagatttgagctttcttcttgaacacctcatacccacagtcctccagacagaaggacaacaggtacaaagtcctaaggattataaaggtatgctgcttgccatcatcttagtgaccaaggcagcgaagctgtttctgtaccttggaacagtcttccctgacaagccagagaacagcgataaagccaccagccttgggatcaggactgaaaaggcaagagtgatggagatttctcctgcgctaagccaagagaaggtttcagcacctcagacagctcccaccgaagtagcggcgctcccagctgcttgcagatgtggaaaaggaaagcctcggtttgtcttgaggttgtcagcagttgcaagacacgtaataaaatgcaatgtgttcctaattcattgcatatcctcagctttaaatttgggtagcaaaatgattactctagattcttcagccttgccttggcaagtatctgtacctaaaaagcagtttttctacctaatctctttttttgtttttgtttttcaatacactttaagcaaattgaagcttttgttcctggaggaaaagtggtttgatatgttcatctatcttttagtaaatttgggggcataacttttcctattctgaggaacttttctaagaagagtgcataaaagtttgttgttgtttttaaaggatgcaacattcagcctgtgtcatgagtttaattatacaatttaaaggacatatgtgcaatgcattttgcagatgtgtgccagatatatatgtgcagataatgggcaagtatatatgtgtgcatatatatatcgggagt

SEQ ID NO: 465250 - DNA, 228 bp, Homo sapiens
cacttccggaccgcggatagcactggcgaccctagcgggtgagaggcccttcagggccgcggcgggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagttgcgctttagagttgt

SEQ ID NO: 465251 - DNA, 1704 bp, Homo sapiens
cacttccggaccgcggatagcactggcgaccctagcgggtgagaggcccttcagggccgcggcgggttgagcgcaccatcacatctaagccatcagcaagtttgttggttttaatctccaaaatacgtcttgattttgtctgactctttgccaccaccctgatctaagcccttatcatctgcttgaatcactggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggtgggtgaggaggggatccagctggggccagtggaggtcaagcctgaatgggggatgccccctggggaaggagttcaaggtccagacccaggtaccgaggagcagctcagtcaggaccctggagatgagacacgggccttccaggagcaaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtcaaacgggtatttggtcaactcatagatgggcctccttttgtatgacaaggcatctgtggttgcctcacattgtgatgatgctgtacaccttcagtgtct

SEQ ID NO: 465252 - DNA, 1461 bp, Homo sapiens
taacgcgagcagtgtgactatctgtacttcataaaggtccatggagagtggcctctgctgtgccacagtgcagtgtgtggagggtgcagtacagcagctttgcagtgtagagacagaatactgttatacaatgcagggagcagagcccacagtgtgcacaggcctcattacagacatctggtacagcatggcagaactggccagggccatgatgcaccatggaagtgccacatccatcatgggcatgacccagagctgcacaaggcacaccgcgccactgcagtgcatttagtggtacactgagctgagacccagagcccctgcggatgacatgtttggagtagggaatcacaaagtgaatgccgagactgctaaaaggaaaagcatccggcgcagacatacactaggagggcacagagatgctactgaaatcagcgttttgaatttttggaaagtgcatgagcagagcggggagagagaatctgaactttcagctgtaaatcgattaaaaccaaaatgctcagcccaggacctttccatctcagactggctggccagggaacgcctacgcaccagtacctctgaccttagcagaggagaaatcggagatccccagacagagaagccaagcacacgggaaatagccacgaccgacacacctttgtctcttcattgccccacaggcagttcttccagcatcttggcttcaacaaacaggccccttctttccataccaccacagtcacctgaccaaataaatggagaaagcttccagaacgtgagcaaaaatgctagttctgcagcgaatgcccaacctcataaactatctgaaaccccaggcaataaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagtacatatatatatatattttaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaacacagttggtttttagggtgccatattgttaaaattagataacttacattgaataaacgaatgcgttttattggtaacaaatttcattacatttaccagttttaacacaggtggatacagaacttccattctttagtcattccaggtggatctgaattttatattcaaacttttaatacagtttttgagttttgtgtgacttgaatttttaatctttctgtaaaatacgtaacttaaatgaacata

SEQ ID NO: 465253 - DNA, 5972 bp, Homo sapiens
ggatctctctaggagctgacactcgaaccttcacgacccattcggatttttccaggactcaggagtggcactgggaagaaggggaccgctttctgcaattggcctcgacactggctgccaagaagacctgtcgcctttgttttgaagtctccagaaatggaagaagaaggcgaagtcagttgaagtcacgagaaatcagcgaggcatttgaaggcgcttcctgaaaacatttattccctgagtctgcaattcaattttcatataaggatgaagaaaatggaaacagaggagacttttgagattgatggaagctctgtgcagctggtcagtctctcagccattactttggaaacaggaaacacctcaaggaaaacaaagaaaccgcttggacccaatggataccattttgttaagcaagttaaagaaggaggacctgcttttgaagctggattatgtacaggtgaccaaattataaaagtcaatggagaaagtgttattggcaaaacctattcccaagtaatttctttaattcaaaacagtgatacaacattggaacttagtgttatgccacaatatgaagacattctccaagtggcatattctcaagatgcctacctgaaaggcaacgaagcttatagcggcaatgcccgcaatatacctgaacctccaccaatctgctatccctggctgccatctgccccatcagccatggcacagccagttgaaatagctcctcctgactcatcactgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaacagaaacaaccatacaggtccttcacatagaattgaagaagtgaggtatggcgtgaatgagcagacctctttaaaaacagtgtcaagaaccacatcaccaccattatcaattcccaccactcatctaattcatcagcccgcaggctccagatcattggaaccttctggaattttacttaaatctggaaattacagtggacattctgatggaatctcaagcagcagatctcaagctgtggaggctccctctgtatctgttaatcactatttgccaaattcccatcagcacatagactggaaaaactataaaacttacaaagagtatattgataacagacgattgcacataggttgtcggacaatacaagaaagattagatagtttaagagcagcatctcaaagcacgatggattataaccaggtcgtccctaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaacggagagaaaaaacagacttacaagtggagtgggtttactgaacaggatgatagacgaggtatttatgaaagacctaggcagcaagaaattcataaatcttttcgaggttccaattttactgtggctccaagtgttgttaattctgataacaggcgaatgagtggtagaggagtgggatctgtgtcgcagtttaaaaaaattccaccagatctaaaaacactgcagtcaaacagaaattttcagactgcttgtggaatgtcactgcctcggggtatttcacaagacaggtcacctcttgtgaaagtccgaagtaattctctgaaagctccttccacgcatgtcacaaaaccatcatttaaccagaaatcatttgtttctatcaaagaccaaagaccagtaaatcacttgcatcagaacagtctgttgaatcagcagacatggtcgagtgaaaacgctggtacttcagatttagaactacctgtcagtcaaaggaatcaagatttaagtttacaagaggctgaaattgagcaatcagatactttagataataaagaagctgtcatcctaagggaaaaacctccatctggacaccagacaccgcagcctttaaggcatcagtcttacatcttggcagtaaatgaccaggagaccaggtcagacactacctgctggctgcccatgatgcacctctcacatgaccacgaatctgttggccctcatagcctgaatgctcagcccaactcaaagacagaaagatcaaaatcatatgatgagggtctggatgattacagagaagatgtaaaattgtcctttaagcatgtatctagtctgaagggaatcaaggtcgcagacagccaaaagtcatcagaagactctgggtccagaaaagattcttcctcagaggccttcagtgatgctgccaaggaagggtggctccatttccgatcccttgtcaccgataacggcaatgagaccaagaggaaaaatgtgtttcgactcaccacgtccgactgtgaatgcctgtttcaggctgaagacagagatgatatgttagcttggatcaagacgatccaggagagcagcaacctaaacgaagaggacactggagtcactaacagggatctaattagtcgaacaataaaagaatacaacaatctgatgagcaaagcagaacagttgccaaaaacacctcgtcagagtctcagcatcaggcaaactttgcctggtgctaaatcagagccaaagactcaaagcccacactctccgaaggaagagtcagaaaggaaacttctcagtaaagatgataccagtcccccaaaagacgaaagcacatggagaaaaggcattccaagtatcatgagaaagacatttgagagaaagccaactgctacaggaactttcggcgtccgactagatgactgcccaccagctcatactaatcggtatattccattaatagttgacatatgttgcaaattagttgaagaaagaggtcttgaatatacacgtatttatagagttcctggaaataatgcagccatctcaagtatgcaagaagaactcaacaagggaatggctgatattgatatacaagatgataaatgcagtttactaaaatgcttctccagaaaactccctgagtctctcttcacaaatgataaatatgctgattttattgaagccaatcgtaaagaggagcctctagatcgtctgaaaacattaaaaagactaattcacgatttgcctgaacatcattatgaaacacttaagttcctttcagctcatctgaagacagtggcagaaaattcagaaaaaaataagatggaaccaggaaacctagcaatagtgtttggtcccacccttgttcgaacatcagaagacaacatgacccatatggtcacccacatgcctgaccagtacaagatcgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgctcgtgtcctccatctttgcagctgctagtcgcaagaggaagaagccaaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaatagcactaggaaagaccccagcacgacaaaagatgaaaagatatcactaggaaaagagagcacgccttccgaagaaccctcatcaccacacaactcagaacacaacaagtcaccaactctcagctgtcgctttgccatcctgaaagacagccccaggtcacttctggcacagaagtcctcccaccttgaagagacaggctctgactctggcactttgctcagcaccgagtttttggccaacgtcagcaccatcacctcagattattccaccacatcgtctgctgcatacttgactagcctggactccagtcgactgagccctgaggtgcaatccgcggcagagagcaagggggacgaggcagatgacgagagaagcgaactcatcagcaaagggcggcctgtggaaaccgacagcgagagtgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcattaactaaagtgtttgatgttatgaaaaaaggaaagtcaactgggagtttactgacacccaccagaggcgaatccgaaaaacaggaacccacatggaaaacgaaaacagcagatcggttaaaactgagacccagagcccctgcggatgacatgtttggagtagggaatcacaaagtgaatgccgagactgctaaaaggaaaagcatccggcgcagacatacactaggagggcacagagatgctactgaaatcagcgttttgaatttttggaaagtgcatgagcagagcggggagagagaatctgaactttcagctgtaaatcgattaaaaccaaaatgctcagcccaggacctttccatctcagactggctggccagggaacgcctacgcaccagtacctctgaccttagcagaggagaaatcggagatccccagacagagaagccaagcacacgggaaatagccacgaccgacacacctttgtctcttcattgccccacaggcagttcttccagcatcttggcttcaacaaacaggccccttctttccataccaccacagtcacctgaccaaataaatggagaaagcttccagaacgtgagcaaaaatgctagttctgcagcgaatgcccaacctcataaactatctgaaaccccaggcaataaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagtacatatatatatatattttaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaacacagttggtttttagggtgccatattgttaaaattagataacttacattgaataaacgaatgcgttttattggtaacaaatttcattacatttaccagttttaacacaggtggatacagaacttccattctttagtcattccaggtggatctgaattttatattcaaacttttaatacagtttttgagttttgtgtgacttgaatttttaatctttctgtaaaatacgtaacttaaatgaacata

SEQ ID NO: 465254 - DNA, 1244 bp, Homo sapiens
acagcttcagaaaggaaaggagacagaagcagcaacatctcaacaaccaatttccaatactatgaatcagatcatttcaaagcagttcccagaaacatgatacccagggagaacccaacaatgaagttatggttgttatttttttgagaagggaaagactactgatgagagatgcttccaaattaaaagtggcaaaggactcaggatatttaaggatgagattccattgcctgatctctttgtctttacattcacttatctgcagtctgactctctcctctcaccatggaatggaaacttagaccttgggaagacttcataattttttctctactgtcatgtttgaataaatggaataaaaacaacttcatgctttggaaactgggaggaaaataaccctagaaggatcttctggagccaaccctcttcaaagaagacaggatagtataattatgaactcagtctctgtagtcatgatgctcacatccaagcccctgcacatcctaggaagattcatcactaagccattactcttcactaattccatggaaaacttcgaactaactcctagcagacatggccgtgtgcaccatcaatcatgtcatgaagcacccaggacctacaaggtggctgctgaagacagcagaaagacagaacctggtgctcagtggccaaggccatcttgtgggccacccggcagccatcttggccaagtgggttctgctgggaaggaaactggtggttgagcaccacgagggcatcaacatttctggcaatttctggagaaacaaattaaagtatctggccttcctctgcaagcagatgagcaccaacccttcccaaggcccacccgccccgccattcctgggcccccagcgcatcttttggtggccttgcagaaccaagaagaaaaagcagctcatgcggctgcagaaacaggccacaaagaacgtggagaagacaaatgacaaatacacagaggtcctaagaccgagggactccctgtttgagaccagaaaagactgtttattcctcatgcttggcctggcctacccttctgccattgcgaccttgggatatgggggagcctacccttcctgcatcaccgccctgggatgtgggggatccaagggcagcaatataggtgccatgggcagcctgggacttaagctgggggcaagggaagggccttagtcactgcctttctataaggttattttaaacagctctaagatttgtacagg

SEQ ID NO: 465255 - DNA, 1259 bp, Homo sapiens
cacatagattctctccatgggctacacaactactatgcctcttctacaacgtcaattcccagatccaagccctagagacattgtgaagatctacagattatttttcacattcacctcccttcttcgagctgtaacacttactgtgaaggtccgcggctttttgaagttagagaaagcacgaacccgccggcagttacacaaccgcctgcagggaagtgtggcgggaaccggggcttccgcggcgtttgcgggccagctaaagctcccggtgtgcgtgggcttgggccccacagggagccgccggccggccctgcccactggctctgccgtccctaggcacagtaccgacccaaaggcgctgcgctcgatttctccaggcgccttagctgctaccccagggactagggctcgggacccgcaccccgccatgcctgcgtcccagcccaccccttgccgtgggctcctgtgcggccggagcctcccgaacgagcgccgccccctgctctccggtgcccggtctcatcgaccgcccaagggctaaagagtgcgggcgtagcaggcagctccacctgtggccccgtgtaggagccactttatatctagctaagggattgtgaatacaccaatcagcactctgtatctagctcaagctttgtaaatgcaccaatcagtactctgtgtctagctcaagcgaatgttactatagtgagctatggtcaaggctgtgttatctgcaaagaagccactggggattttaaggtcaattagaagtaagcaactaaaagcatgcaagcaggttcaatttggtgagcttaatcaggctgtacaggaagcatggctggagaggcttcaggaaacttacaatcatggcagaaggcgaagagggaggaggaacgtcttacatggccgaagcaggagaaagagagcaaaggtgggaggtgctatgcacctttaaacaaccagatctcatggaactcactgtcacaagaacagcaagggagatgtctaccatcatgtgggtagactcccagtcacctcccaacaggccccttctccaacattggggattacaattcaacatgagatttggacagggacacaaatccaaaccatatcaacaaccatatgcgttatatattttaattcccttattacagatgagaaacctgatactttaagaaataaactttcctaaataagaaactcataaatggcagaagtgaaatttgatttcaggtttttaagaccccagagcatgt

SEQ ID NO: 465256 - DNA, 1336 bp, Homo sapiens
caagcaagaccttaaggtataggcattttccatgtcctaaaagccagtgctctttttttttttcaggttctgtatctacagcaaatctgataatagatgatatatatggaatgtgatgagccaaatgaacatcttcaagaatttgtagcatgaccttgttaaaagttgcagaaaaacatcagtcattatggaaaacagatcttccccaccacagctgggtctccagatagaaaatactgagaaattcaaaaattcatttgagctggaccaactgtacaatgtgcaaatatccctgagtttcaaatggctgtcatttaccttctgtctctaaacttctactgagaataatttttaaaaatattttgtaatatctctggagcaaaagccttacttctttggtgacatttttcacttatttttttcatgtctacttgataaactactgaagagaataaacaaaacgactatggttgatggctggcaactatgtttatgtgaagaggctgaagcttttcacattggtgctgagttgacttgtaaaatatccagttttacatagttctgaatggtttaaaatgacattcaggtgggccaaagtaaggtggtcaacttttttttttaattgtaaatatatttcattacatctgaaagttatttttacttggagccaggatggttctattttagaaaaattatgcctatgtttatttggtcttaagaaaaagaacaccaaaatcacccagtagattgtttacttaatgccagaggacttaactgtcactcatctcaggaagtgaactcatttgctggtaaaagcatcatttctgtggcctgctgcatgcactggagtatttcagcacctcaaggagttacccataacaccagagtccatgaaggaaatgatatacttttcccttttcttgttcaccctgtgatgcaaaaaccttacaatgtatttattttttatctggcgaaaagcaataatgaaaagaaatgacactgaactgataatgaggaaaagcaagacgacattcctaaaggttaaattgacaagggaaagaaaatggtaggccaggaaacaatggcaagataatcccaaagtttacagggtgtgaacctgaaaactgatttgaataagctcagaagtaatttgtcttggatcccaggtatattgacattggaatgaccaaaggaaagtttgtgtttaatactttttcatgaaatggccattccacccctaaacggatggataatttacaacttctctctgcttaacattcattggctgcatcagaacacaccagagtcattgcctcaagggccatctcttgggcct

SEQ ID NO: 465257 - DNA, 2677 bp, Homo sapiens
cagccattactaacccacattgcctctaattccacagtcttttcactgtcctacattgcctctttgaattctttggcatacactcttaacctgtgaaaatgtgtcacaaccatgatgcccaactcaggttcttcttagttgttcaagttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccacccgccgcacgaccaccaggcgtccaacaaccacagtccgaaccactacgcggacaaccaccaccaccacccccacacccaccactcccatccccacctgtccccctgggaccttggaacggcacgacgatgatggcaacctgataatgagctccaatgggatcccagagtgctacgctgaagaaggtaactgcctttgttctaatgctaactacttaccaggcacactagcacgccgcaactcagagcagggtggcagagcctgcaggggaggtatgagcaccgtgcacagcaaagcagcaacccgatgcatttttggtcccagcagccctcctttggagaatgccaatcctcatgtagctgggcttcctgtgggagtgtgggctttccactgggtaagaatgcaccattttcccttctctgctgatctgcactatcctgccgcccctgatgtcatcgtggagcccgtatatcaatatatctccatcttttctgctcagtcccctgctcaagctgctttggaagaagtcattctagatttgcatcaggcatggaggagagagattcatcttctttccctcagtttgaaatgaattgcaatgtcaattataaagcttaagtctttttaaaccaaggcagagtgaagatgtttcctttcaggaatcaagctggaattcttatgcaacgttattgactatgataagcccaatcagtttgaacatgaatactgtatccaaaatgggaattctgttggaagttagtctttccgtgaaaaagttacaaataaacaggaaaacttgacacatctaaaaaattcacaccaaaaaaacatggaaacacgtacagagggagaggaacaatgggaagaaaatttctactctgtccattgacccagttctgtatctacagcaaatctgataatagatgatatatatggaatgtgatgagccaaatgaacatcttcaagaatttgtagcatgaccttgttaaaagttgcagaaaaacatcagtcattatggaaaacagatcttccccaccacagctgggtctccagatagaaaatactgagaaattcaaaaattcatttgagctggaccaactgtacaatgtgcaaatatccctgagtttcaaatggctgtcatttaccttctgtctctaaacttctactgagaataatttttaaaaatattttgtaatatctctggagcaaaagccttacttctttggtgacatttttcacttatttttttcatgtctacttgataaactactgaagagaataaacaaaacgactatggttgatggctggcaactatgtttatgtgaagaggctgaagcttttcacattggtgctgagttgacttgtaaaatatccagttttacatagttctgaatggtttaaaatgacattcaggtgggccaaagtaaggtggtcaacttttttttttaattgtaaatatatttcattacatctgaaagttatttttacttggagccaggatggttctattttagaaaaattatgcctatgtttatttggtcttaagaaaaagaacaccaaaatcacccagtagattgtttacttaatgccagaggacttaactgtcactcatctcaggaagtgaactcatttgctggtaaaagcatcatttctgtggcctgctgcatgcactggagtatttcagcacctcaaggagttacccataacaccagagtccatgaaggaaatgatatacttttcccttttcttgttcaccctgtgatgcaaaaaccttacaatgtatttattttttatctggcgaaaagcaataatgaaaagaaatgacactgaactgataatgaggaaaagcaagacgacattcctaaaggttaaattgacaagggaaagaaaatggtaggccaggaaacaatggcaagataatcccaaagtttacagggtgtgaacctgaaaactgatttgaataagctcagaagtaatttgtcttggatcccaggtatattgacattggaatgaccaaaggaaagtttgtgtttaatactttttcatgaaatggccattccacccctaaacggatggataatttacaacttctctctgcttaacattcattggctgcatcagaacacaccagagtcattgcctcaagggccatctcttgggcct

SEQ ID NO: 465258 - DNA, 1355 bp, Homo sapiens
ttagatttaagtatttgatccatcttgagttgattcttgtataaggtgagagatgaggatccagtttcattctcctacatgtgacttgccagttatcccaggatggctggaaaagccaccatagaaattgaagtgtcatgtgtcatagagtcagacaggcgtcatgacagccattcacaatcgtggaaccttgagccgggcggttaacctgtgtaagccttggtttcttcatctgtaaaatgagggtaatgctatccactcttcagagccattgccagaaatatatgaatgaatgactccaaaatgtctcccatatttgcctcttcaaccgacgtttaattccctctttgctaacagggaaaatgtccctttactgcttaagggagagagaataaaggcggaagcaccaggttaagaaattctgatgttttcacgcattagctggtgctcctagctttctgatttccattttctagataaggctttaaggataaatttttccttaaaataataaacattcattctcatcatatttggagccgcggatagtccacctgggccgtctgggtggtcagcccccaaatgcaaaggaaggaagagcagggctgtcacttgactcttggtggcagctccaaaaaggcaatggtgcctgctcaccaaccaggaatgaagaccttccaatcaaaaaacaagacaagaaaagctgcccctgatgaatcattttcaggaaacacagagaagcagcagcaacaggagaaaaaccacattgcatacgtaaatctaagtcacaggaaacacaaatcccagagacaacctcagttatgtggccctctagttggactcagaatggttctgaccaacactgggttcagtgtggccgaatttacatggagggtgggtttgcagcagaggatgccatctctgtgggctttcagaggcattgaagaaggagatccttttccctccctggggttccaagaaaacactctcttgggttgactttacattttacaagtaaatgcaaataatacctggaagagataacactcttttttcagatcaaacattaacacttaatttgaattaactttagcagttgaggagcattgagaccattatgaaataatgctatttctctggttaaagctggttcttacttccaatgacatgttttggaacacgctcgtcgatggacaaacacatgtgtccttccttcgagattaaacagtttgagttagtcttaagtttgtcttctccattgttgtttggcaagaaaacttgctacctcctttcagaaaacaatgtgtcaatgcatttttaattaaagtcttattttgagataattatagattcac

SEQ ID NO: 465259 - DNA, 1512 bp, Homo sapiens
  misc_feature (1483)..(1483): n is a, c, g, or t
tcctattcgaccatcttggctccaccccctggagaaatcttctatgcagaaaaattccaaatgcatactccctcttcttaagtgtgggctgaccatggtgacttctttcaaagaaagatatatagatgacagtttttcttctctaattaagagaatcttatcttttcttctcctccattatgacaagaaaagaaataaattgatgctgccttgttttaaaataatagaagtatatagtacttttaaaaagtattttacaaggaagatttggagaattcactttatcatcgataaactcacaaaaaatacaggaaagaagaaagataaccaaggacattacaaaggagctctgtgtcagaagctaggattaaagaacaaatacagaacaaattattcctccagcacccctactgcaaggattttaagaactctatctcaggataaagacctgagggtcacaagatgtacattgctggcctcagctggattttcccagggtcaggtgcccattcctacctaatcaaaggtcatgagtcctcacacgttttcaagagtttggaaaatgatctcccttgccagactgccaatcttcaaagggagttctatatgtggaagaaaaagaaaaaatttatgtgcatttaccctgtttaatacactcatcatatatagtatttttgcaacagcaaaaataacactcttaatttagtatgtaattatatatgtcatatacttaatatacaaaatattttccttgctaacctatacgatttcaaatgcctggaacaatagataattcatgtgattacttgagagtatgtaaattttaatatgttaacatatactggcaaagttctaaaagttgcgattttatgggaggccaaattatgtacatattagtttgtctgaagacttgagccaaaaggaaactaatacacttctgagctacaatatggacataatgtcatgaagcaggaacattatgctccatttcaggacacttctgctgacctgcacctagaataccctgttctgtgctgatgactcagatgtaagaatgatgaagtgcatcggctggcatgcagagaacaataagaaaaagaactgagttgtgggaagacatgaggaaaggacatgaggctcttaataacagctgccaagtactgcagtcgggaatctggagcaaagtgattcaattctgaccactgcctgtgagtaaatgggattttatttttcaatacttttgtttaatagtacctccttcattacatgtgaacagcactccaggacagtaaatcatgaaatgggaataaagcctgtaattttaattaacatattttaaaatgtttctaatttgtatgcatttgatcaaattttcatttgcattgagctattttttttctttctcatgtaatgtttgacattaccatttctttctttaatgaaatactaatatttaataaaatatattacatccttaaaaaanaaaaaagggggggcccggtccccattccg

SEQ ID NO: 465260 - DNA, 1045 bp, Homo sapiens
  misc_feature (1016)..(1016): n is a, c, g, or t
tcctattcgaccatcttggctccaccccctggagaaatcttctatgcagaaaaattccaaatgcatactccctcttcttaagtgtgggctgaccatggtgacttctttcaaagaaagatatatagatgacagtttttcttctctaattaagagaatcttatcttttcttctcctccattatgacaagaaaagaaataaattgatgctgccttgttttaaaataatagaagtatatagtacttttaaaaagtattttacaaggaagatttggagaattcactttatcatcgataaactcacaaaaaatacaggaaagaagaaagataaccaaggacattacaaaggagctctgtgtcagaagctaggattaaagaacaaatacagaacaaattattcctccagcacccctactgcaaggattttaagaactctatctcaggataaagacctgagggtcacaagatgtacattgctggcctcagctggattttcccagggtcaggtgcccattcctacctaatcaaaggacacttctgctgacctgcacctagaataccctgttctgtgctgatgactcagatgtaagaatgatgaagtgcatcggctggcatgcagagaacaataagaaaaagaactgagttgtgggaagacatgaggaaaggacatgaggctcttaataacagctgccaagtactgcagtcgggaatctggagcaaagtgattcaattctgaccactgcctgtgagtaaatgggattttatttttcaatacttttgtttaatagtacctccttcattacatgtgaacagcactccaggacagtaaatcatgaaatgggaataaagcctgtaattttaattaacatattttaaaatgtttctaatttgtatgcatttgatcaaattttcatttgcattgagctattttttttctttctcatgtaatgtttgacattaccatttctttctttaatgaaatactaatatttaataaaatatattacatccttaaaaaanaaaaaagggggggcccggtccccattccg

SEQ ID NO: 465261 - DNA, 430 bp, Homo sapiens
tttttcctggtgtctccatttttatcttatgtcatctctgatgctctctgaagccacgcccttttcagtagttgaaaaccttttatttgctgctttctcataatgccaattggtacgtaaatttgattgtcttggccctggcttaaagctacacatgcttctgccttttgccttcctggttgcttaccagcttttgtatttcccaactgaaaattactgcaaaaaatactttgggtacaatatatacttttttccttttaggtcacaagatgtacattgctggcctcagctggattttcccagggtcaggtgcccattcctacctaatcaaaggtaaggatgaagttggccttctgtgtgagccggtgggggaggggatgagatggttaacttcatgtgtcaactcatccaggttatggggtcaagttct

SEQ ID NO: 465262 - DNA, 3304 bp, Homo sapiens
gagaactctgtacgttctttgcaacttctctgaaagccacacacaaacccatccatggtgacaaagtgccagtcagtgattgtatgaggtggggcggtttgttgcggatgatatgaggggtctttttggggtgatggatgttactgatgatatgaggggtctttttggggtgatggatgttactgatgatatgagggatctttttggggtgacagatgctgtggatgatatgagggatctttttggggtgatggatgttactgatatgagggatctttttggggtgatggatgttactgatatgagggatctttttggggtgatggatgttactgatgatatgagggatctttttggggtgatggatgttactgatgatatgaggggtctttttggggtgatggatgttactgatgatatgagggatctttttggggtgatggatgttactgatgatatgaggggtctttttggggtgacggatgttactgatgatttgaggggtcttttcggggtgatggatgttactgatgatatgaggggtctttttggggtgatggatgttactgatgtgagggatctttttggggtgtggatgctgcagattctgcacccaccgccctccatgccctctaccctgctgaccaactccccgtccaccttctcccagttggcccagctcaaggggcagccccctgcatcgaaagcagttagggcctcctcctccggcaccacctgggaaaaggtgactgtggcctctggaaaggcttcctggctccgactcttgggacctggcaccctcatccctggaggtcaacactccaatgtccgctgggcgtctgacctggaggacagggctccaaggcacagcccatggctgagagtgaagaaacggcgccctcatggcggaccctccaccaagcggccagtgaacgaagtgtgtttgtacgggagggcttccagccgccgcgacccccaccatcgagaaaccatcctctgggcccaccgcagaactcactgtgcccacagcggggctctctggggagggtcctcggagcacagtggcgaaccacttgctgcggtggtcactggtggtcagcccatagcaaagcgtctggccctgtgcccccaccctgccagcaccaggctggacagtccccagcggctgcacggtggcctgggcagctgtgatgggagaggcccccacagacgaggccccaagtcggctcctggctctgccctggaccggctctgggttctcgagaggctggcccagccctgcgctgctctgagccatgcggaccccgtggggaggaccccatactgcagatccctcaccgagtcctacaagaaggagcctcagagaacagagcccctggcgccccagcccctgtggaaagacatggtctgtgtgcctggaaaacgatgcaaggccgtggtgcctgtgacgtcctcagactcacaccccaatgcgggggactgaacgtttgtgttctccccagttcacaggttgaaggccttgcccccagtgcagctgtgtctggacactgggcctctgggaagtgatgatggtctgtgttctccttgtggctgcagcagccgcactaagacactggccacacctggtttctccacagccgctgcagccacgaggagaaggccaccctctcgcgttcaaacacaggtgcacccaccgtggaaccacagccacagtggagctgtggaatgtgcccgtcacccacagcccgcctctgagtcactgccgtcacccacagccctgccccgacccacagcctgcgtctcagtcactgcccatcacccacagccctgcatctcagtcactgcccgtcacccacagccctgcctctcagtccctgccgtcacccacagccctgcctctcagtcactgcccgtcacccacagccctgcctctcagtcactgcccgtcacccacagccctgcctctcagtcactgcccgtcacccacagccctgcctctcagtccctgccgtcacccacagccctgcctctcagtcactgcccgtcacccacagccctgcctctcagtccctgccgtcaccctggctgctcctggagttgcacagaaatggaattgtgtgcttggatgcctccgtgcccagcccctgtccctccgcgattcctccttgctgctttgcggagcagttgttggccgctcacagctgggcagggcccgtcctggcaacagacccctcctgctgcggtggttccctcggtggtggacggggctgtcggcacattttagctgtcaccaataaagctgctgtgaacatccctgtacacgtcgttgtgtggaatgagtttggtgtgtcttagggaactccttgggagtggaatgcctgagtcaccagaccctccctccctctgccccgcacagcccccctccctccctctgccccgcacagcccccctccctccctctgccccgcacagcccccctccctccctctgccccgcatagaccctgcctccctctgccctgcacagccccctccctccctctgccctgcacagcccctccctccctccacctcacacaggccccctccctccctctgccccacgcagaccgcctgcctccctctgccccgcacagggatcctgcaggttcagggtggagtggcctagcccaagccctcagcctttcctttcctaactttgaggagggcacacgtgagatttccttttaccaacagagaatctccaaatccagccttttaccagaagcctctccgagaaactgggcgtctctcccaggaccacagccccccagcgaccgctcagcacttctgtggcttcggcggcagcgcccgcggcttcctgtcactctcccagctggctgaaggcacagaccctcagcttccacaacccacaactccgggaggggattcccaaccacagacaggggtctttcccccgcaggaaacctcccacccttcttcaggctgtcagtgaaacggcagccacttttcaaaataacagtttctccctttacgtgacattaaagaggaaagcactctgccttcacctcagttccgtcgcccacacgacaatctctagggggctggggcttgtgctgatgggaccttccctcccactcataaccacctagaatgcagccggtgtctccctgcggctggtggtgtttcagagctaacagtccgcacaatgtgtcactggccctggccgttactccatgcggagccaccactcctggcccctttccccatggaaaagccagctcctctcctccttcctgtggaca

SEQ ID NO: 465263 - DNA, 248 bp, Homo sapiens
attgatagttaaaatttcatgtgccctggattgatgtttgtgcatcaggacaaatgattagtgtcttgccgatagtttgaacaggtgtacgttaaagattatttaacaccaagttctgttttctgtcttcagattctctaggaaacaagaaatcaaatctccggggactatccaggtgggaaatggaaataaatgaagatgcgacaagccaaaatctcccactctcgcgtgatagaatgtaaaataaa

SEQ ID NO: 465264 - DNA, 1716 bp, Homo sapiens
acagtgaaaaaaaaaaaaaaaagaaagaaaagaagcattgatgcggctgtccagcctgttggatcagctgcaacccaccctggtatggactgaggggtctccctgggctgggccgagcaggaggaggctgagcagtgaaaacggtgacccctgccctcacggagctaacgagaagagcaaatggctggcaacggtgcatgacacagaatgagcaacgggctgcacacatcgcgatttacgtggctttggaaaaaacgcgtctcacaagttggggctgtcatacattggcttcttggtaatcaatgcgtttcagcaatatatgggggtgagtttagtttccagttggcttccctgagggtgttggataaaattgcaatttagattcaatcaatacacatttagttccagcagcactgcgctccctgcagcctccctggatgatcttctccgcagctgcctctacctacagatgctctctgcctcaaagcctgcaaaccgataacgatgacctcacccaccctctgccacctccagggagccccggtttctcaggtcctcagtgcgctacagatgcttgcttcaagggagtgcccagatgctatgctggggagtctgggttcaccgtggccaccacaaattacagcaccttcaacaccatatgtgagtgctgggtgtggccgggaaagatctcggagcctcctggcacacagacacggaagctccagtgtcagcgacgatcacacctccctatgcgtgcgaatgccagcaatgtgtgtagaatccctgagtcttcacaagaactgcgtctgaacataccagagcctgcagtggagaccttggaatcggacccgggaaggggcactcaccaggacgataactggcagccctcggaaatgacggaaatgcaagactttgaaagtaaagatgcttttaggctcttaggtcccggggatgaagtcaacacttctcatccaggatcccctagtgcaagctggggaaggttctggaggccagaagcccaaaatcaaggtgctggcagggtcggttcctcctgcaagctctgagggaggagctgtttcatggctctctcctggcttccagtaattgctgtcacagctacccagcaggccagagggaaggtggggaagcagccaccattgctgatgggcggaagaactcctgatggctgagagcccaggcaagtctgggaaaggaaggtgagcggacaggttctcgctctgtgagccaggctggagtgcagtggcatgatcacagctcactacagcccaaactcctgggttcaagcaaacctcctgcctcagcctcccaaaagaggaatcaattctggaccggaggatgtctccctgcctttgccctgcctgcctccccccacatccttctctggcaaggggaatgaggctgagaatgacctccatccgcaggacgagagcagattatggacggcagagctgtaccttgtgattgaacagaatctgatcaggaaccttggcctgaaagctcggcagactgaacgcttcagtgggatgcagctcatttgaagtcatccagacctcaagagctcctttctcctgacctttgacgttggctggtgcctggtgtgcatcatggggagttccccaaggacccagatgcctgccactgtgccatcagggaggtctggcctccaaaggcctgggcagatcctgggagagaggg

SEQ ID NO: 465265 - DNA, 2369 bp, Homo sapiens
  misc_feature (5)..(6): n is a, c, g, or t
  misc_feature (8)..(8): n is a, c, g, or t
  misc_feature (13)..(14): n is a, c, g, or t
cccanntntcttnnaggaagcattgatgcggctgtccagcctgttggatcagctgcaacccaccctggtatggactgaggggtctccctgggctgggccgagcaggaggaggctgagcagtgaaaacggtgacccctgccctcacggagctaacgagaagagcaaatggctggcaacggtgcatgacacagaatgagcaacgggctgcacacatcgcgatttacgtggctttggaaaaaacgcgtctcacaagttggggctgtcatacattggcttcttggtaatcaatgcgtttcagcaatatatgggggtgagtttagtttccagttggcttccctgagggtgttggataaaattgcaatttagattcaatcaatacacatttagttccagcagcactgcgctccctgcagcctccctggatgatcttctccgcagctgcctctacctacagatgctctctgcctcaaagcctgcaaaccgataacgatgacctcacccaccctctgccacctccagggagccccggtttctcaggtcctcagtgcgctacagatgcttgcttcaagggagtgcccagatgctatgctggggagtctgggttcaccgtggccaccacaaattacagcaccttcaacaccatatgtgagtgctgggtgtggccgggaaagatctcggagcctcctggcacacagacacggaagctccagtgtcagcgacgatcacacctccctatgcgtgcgaatgccagcaatgtgtgtagaatccctgagtcttcacaagaactgcgtctgaacataccagagcctgcagtggagaccttggaatcggacccgggaaggggcactcaccaggacgataactggcagccctcggaaatgacggaaatgcaagactttgaaagtaaagatgcttttaggctcttaggtcccggggatgaagtcaacacttctcatccaggatcccctagtgcaagctggggaaggttctggaggccagaagcccaaaatcaaggtgctggcagggtcggttcctcctgcaagctctgagggaggagctgtttcatggctctctcctggcttccagtaattgctgtcacagctacccagcaggccagagggaaggtggggaagcagccaccattgctgatgggcggaagaactcctgatggctgagagcccaggcaagtctgggaaaggaaggtgagcggacaggttctcgctctgtgagccaggctggagtgcagtggcatgatcacagctcactacagcccaaactcctgggttcaagcaaacctcctgcctcagcctcccaaaagaggaatcaattctggaccggaggatgtctccctgcctttgccctgcctgcctccccccacatccttctctggcaaggggaatgaggctgagaatgacctccatccgcaggacgaggtattaaatattcagcccatgccagagtgaggatctccttttcaccttctgtctgaattgtgccttgaatctgtttcgcgatgggtgcgaactgggtgagacacttgtcttagaaccgcagccctggcaactccacgccgcctgacctcgagccggtttccatagcctgaatccttcctctcatttgcaaacaactttcttagtaaatgatgacaaagcagaatgcaatcccttctataagagatatgactcagaacaaattgtagccgcgttttcctcacttttctcctgcgtggatacaagatcaatatatagaaattaatggaattttctatactagtcatgaacaatttgagaatgaattttttaaagttcattcacaatagcatcaaaaataaacagtttggaataaatttaacaagaaaaatgaaaaattggtacactgagcattataaaggattgcttagagaaatgagagaaaatataaatggagagatattccatgttaatggattggaagattaaatattattaagatgtcaatccatagatcaaattgatctatagatgcaatgtaatccctgttaaagtcccagcaggattttttgaagaaagtgacaagctggttctaaaatgaatgcagaaatgcaaaagacatacaattgctgaaacaatttggggaaagaaaaacaaagctggaggacttatcctacccaatttcaaagcttactctaaagctacagtaatcaagaccgtgtggcattggagtaaggataggcatatattgataatggtacagaagtgaaagccaagaaataagcgcttatgtatatggccaacggatttttgacaatgatgtcaaaacaattgataatgatgtcaagacaatggaatggggtgggatactcttttcaaacatggcattgtaacagttgg

SEQ ID NO: 465266 - DNA, 1564 bp, Homo sapiens
acagtgaaaaaaaaaaaaaaaagaaagaaaagaagcattgatgcggctgtccagcctgttggatcagctgcaacccaccctggtatggactgaggggtctccctgggctgggccgagcaggaggaggctgagcagtgaaaacggtgacccctgccctcacggagctaacgagaagagcaaatggctggcaacggtgcatgacacagaatgagcaacgggctgcacacatcgcgatttacgtggctttggaaaaaacgcgtctcacaagttggggctgtcatacattggcttcttggtaatcaatgcgtttcagcaatatatgggggtgagtttagtttccagttggcttccctgagggtgttggataaaattgcaatttagattcaatcaatacacatttagttccagcagcactgcgctccctgcagcctccctggatgatcttctccgcagctgcctctacctacagatgctctctgcctcaaagcctgcaaaccgataacgatgacctcacccaccctctgccacctccagggagccccggtttctcaggtcctcagtgcgctacagatgcttgcttcaagggagtgcccagatgctatgctggggagtctgggttcaccgtggccaccacaaattacagcaccttcaacaccatatgtgagtgctgggtgtggccgggaaagatctcggagcctcctggcacacagacacggaagctccagtgtcagcgacgatcacacctccctatgcgtgcgaatgccagcaatgtgtgtagaatccctgagtcttcacaagaactgcgtctgaacataccagagcctgcagtggagaccttggaatcggacccgggaaggggcactcaccaggacgataactggcagccctcggaaatgacggaaatgcaagactttgaaagtaaagatgcttttaggctcttaggtcccggggatgaagtcaacacttctcatccaggatcccctagtgcaagctggggaaggttctggaggccagaagcccaaaatcaaggtgctggcagggtcggttcctcctgcaagctctgagggaggagctgtttcatggctctctcctggcttccagtaattgctgtcacagctacccagcaggccagagggaaggtggggaagcagccaccattgctgatgggcggaagaactcctgatggctgagagcccaggcaagtctgggaaaggaaggtgagcggacaggttctcgctctgtgagccaggctggagtgcagtggcatgatcacagctcactacagcccaaactcctgggttcaagcaaacctcctgcctcagcctcccaaaagaggaatcaattctggaccggaggatgtctccctgcctttgccctgcctgcctccccccacatccttctctggcaaggggaatgaggctgagaatgacctccatccgcaggacgagattctctaggaaacaagaaatcaaatctccggggactatccaggtgggaaatggaaataaatgaagatgcgacaagccaaaatctcccactctcgcgtgatagaatgtaaaataaa

SEQ ID NO: 465267 - DNA, 923 bp, Homo sapiens
gaaaacttgtttttagggagaaaatccctatatctttgtttaaagtctcagatatgtctttatcagcagtgtgaaaatggaccaatacactaaattggtatcagaagagtggggtgttgctgaaaagatacctgaaaatgtggaaacaattttggaattgggtaacaggcagaggctggaacggtttggaggatcccagaatggtagatccactgacagcttgcaccatgtgcctggaaaagccacagacactcaatgccagcccgtgaaagcagctgggaggaaagctgtaccctgcaaagccacaggggaggagctgcctaacaccatgggaacccacctcttgcatcagcatgacctggatgaggttacagctcctaaatttataactacatttccacatctggatttacaaaaagcaaagttaatgtttgtgaagagtggacaatatccaaggggtgtatatgtcaatcccaaaccacatgactttcgacagctgatggaccaaaacagcatagggcttcctgaactctggcctgaatgttcatctcccgtgcatttcccagtgagaacattgatgaattctggcaccttcctggattctacagaaatctgcactctcccagaggcatgagaaagtgctaaaacaacaaatgaaagttgcataatttgaaattcccttgttaccacagggatcagaatccaatcataaggcttttgatttagtttgtgaaagttagatcttgcaactatgagtggaaatgctgataatgtgctttctgttaatgtccaaagttaaagatgctctagtctcagttttttctaatacactttaagaagcttctctgagacactcaagtatatcaaaagagagaagatctccaagtaacagaaataataaatgtccttcttaaagaacacca

SEQ ID NO: 465268 - DNA, 4731 bp, Homo sapiens
gctcaccaagtacttactaagcttctctccagaaattacctcgagctgcaaagtgagttgggctcaggttggcatgcaggcattttccattccaagggacaggaagtggctgttttggacgagtcccgccataaaaccactttcccatgacttcccgaacagtaaaccccagcttgggtaccagggaatggcgctttcagtttttaatggactgcagctgaagcaagttcaaaagtgcgaggattgtaaacttgagagcaactctgcagatgccgcacaccgtggcagaatgattcagggggccaaactttgcctcatcaagtcagagaattttctgcaaatgaacttttcaagaattatgccaaaacactggcaaacacacgcacagaaatgcacagaaaaagaataccccaacattgaacaccaaaggccctcagactttggcgcctccattttgaagtggtttgccaccattaccaattaaaatcctatacctctctgagatccagttcaaatgctacttcttgaagctctttttgatactgctttctcactttcctcaagaggccattatgtcctgtccttttgaagggcatgtttctcaaaagccaaggttgtacctttagtttcttgagagccaaggttgcatctttagtatcttcagtcatctttgcaccccagaatgtttagcacagagcttgcccatgatggctactcaaatgctgaaaggatgaatgactaaataaatcttgagatcagttgtatttttttctttaaaataactggctacagtcactggctctcaaccctggtgttgggctcatggggacattgtaatcagttgtaagcgggttgaagtgatttgttatgaatgattgttaggttttggaagtttgcaaactatgtactgtttgtataaattagaatgtttcccttcagtaatattctttaatgataatatcatcatcctgcagtgttaatacttcagtgtgacactctcccttgcattgtgatttgtcttaaatggaagaaaaaaggatggacttagagtcaggacccaggaaattgtatgttaatccacagcctatcttttctgtgccaaagcccataataagccagaaatcactgctaatggttatggaactatggaaatatgatagtcctctactactgtacgagatgtgggggccttgtcaaaatgaacattatctgtcaatttagagaaaagaataaccattactctaaaccaggggtcagcaaacttttacagtaaaggtctagatagtaaatatttgagggcttttgagggccatacagtctctgtagcaactacccaacttcgctattgtaatgcaaaaaagctattgtaatacataaatggatggacatcactatgttccaataaaactttatttacaaaaataagacggaggtcacattgggcttaatgagctgctctaagccatagagtacatgggaatgtaaaccatactgcttattttttttaattgtattaatggcatttattctacttcctttgtaatagctaaggagttcctgcaaagaaagaaaaattaggggttagtaaatttgttacttatttgcaagaatattcagtatatatttcagggttaatattctctagactttctcagcataagaaatgagatgaaattctgttgatgttgtaaataccactattgaggctaattcgtgaaagaaaggtgactacggtatttgatgaagtaccttgtcttccaagaagtttgcttttgtggtattatctgtggcacgttattttctgtcttggtactttctctcagtgggatatttaggctctactttcctgcttggcacttttgttaataatgactttaaaaatcctcacttctctttttaaattgctgcatggagtaatagcctctctccttgacagtcaaaaggccaagaagtgcaactatgtgaaataaacttttaaaacaaggccccaagtgcactgcaagttgacttgaaataattagtccctggagtttggacacccacaaagtatctttcggaactcggattcagaaatgtctcagtgacagcctgtggcgggaagccatcacagcagcagggcccattgctcttgggacatcccacactgtagagttactttggcagtgcctggaagcagcggcccctgcccacatggcttttccactgtctcacagccaagaaccatgacaggcccctcagaacttgggccctctccagtccttgagccagtgttcaccctcacaggaagagtgtttccctgttttatcagcaagtaacagaaaacccagatgactgcagcttacaaagtaaagacatttctctcccattacaagaagcgtggagaaagcatgttgtagaggctcagtgttgtcacagaggacctaggacccttccaccttcctatgctgccatctcagtgttgggggatgacttccctcatggatgcaagaaggttactgaaacgccaagtataatgtcactacctcatgtggcaccgtgctttacgcgtcactccttcactaagggatctgagctgtaacctgacctgtagctgtcatcagggctttttttccatccctgtcatggcatgggatcccagtatggagaagcttagttggtattcaagtcatccgcatcgtacttgaccacgtgtgaacaagtaacctcatgtttctggggacaggcagggagaaacttgagaacttgatccccttgggggcccttggaggattgcttccaccaagccctgggttttgcaagtgactcgtttcccaatctatggcacatccaagcctctttggttttctttttccctgttcacacggatatatttgaggcaccatactctatctgcccaagaaaggaagaggggcaaggaaaaccgtgtaagtcatgcttgtttaaatattttggcttctgccaaagcagatatgagaacaattggactataatgagagttttccattggcctcaactatcctggacagttgaacgccaagcctagtttgataggtacctactatggacctggtggagctccttcttaaaattagacagtgtgtactggccagaatgtctcagcttgcagcctgaggatgattatgctgatcctggaggccctggggaactgtctagggcactaggggtgcctgtgctaacagcaaaagaccactcccccccaacaccacacttgcacatgcctcatgcacagaggaagtaggtgccaggtcttttcagagaagagcttcaaagccctgctgccacctacgagagcctttgatccatctctcggctgaatccagcccctcacggggctgatccgctttgaaaccagagccagcagcccctctacaactccctctgagttacctcacacagacaagagcacaggcttctggggggcttctttttatcttccctaaattgcgagaggtacttctttcagcgttgtcctataggattcttaagaactgccggggagatgtcttagggccaacacaaagaattgcaaacaacagcccagtgtcttggaaactttctctacagtttagtacggataaaccacatgcagatagaaaataggaagaaaaggaaattcatggtaagcctgcgtattttcttatttcgggtgcgaggggagtggagaaatccgtcatggataaaatccaactttaatgacagtctgaagccctgaagcacagacatattgcagagctaatgtattattttgtttttgtttattctgcagaaatggggaaatttcattttttagtagaattacaagctccccttttactattcacaagccctaacatgcatggcatcctgagccagagagccttccgtgattttaataccagcttctttgtgaatctaaactggttttccagtccactccctggcgggccacgggggttgttggagtggtgttacacatacttagctttctttgggtgcttgaccaccgcctgttctcaggggggacaaggagccttgctgtgggcattaccagtgggagtccttctctgttacactcttcaaaaatcgtctgtacatacttgcctctatgttcttacaactttgtttagaacttaacatttaatatgtaacctagcttcaaccccattttctaacaattctcctgctattcaccagagacctcctaaatcagcgatccacctgtcttttctcagtccttctcctccagcacctctaacacatctgccatttttgagttctcctcctcctggaaatcccttcttgtcattcaactctgtctgtgactccttccccagcgcagtaaacgtggacactgtccaggtgtagtccttggttgtgttttcttttcacgccacgacattccctcatctctttgcagaagacatttgcaacttatctgcaaatccgagctctctttctgatgttccactcccaaatttctgaccgtggctaggctttcctcacggtcttctaaattcatctcgtcccaagcaaagtctctatattcccctgaaagcctccacatgcttctgtgttcctgatgttaaccagttccccagcctttacatcttagcatcgccctttgtgttgcatcactgccacacactcgtgcgttccttgaggttctgcctcctaagtgtgttttctcaccttagctttgccccgtgtctcctgccattttcctcgagtcac

SEQ ID NO: 465269 - DNA, 3741 bp, Homo sapiens
  misc_feature (11)..(11): n is a, c, g, or t
gagatggagtntcgctctgtcacccaggttggagtgtagtggcgtgatctcagctcactgcaagctctgcctcccgggttcacgccattctcctgcctcagcctcccgagtagctgggactacaggcgcccgccaccatgcccaactaattttttgcatttttagtaaagacagggtttcaccatgttagccaggatggtctcgatctcctgacctcatgatccacctacctcagcctcccaaagtgctgggattacaggcgtgagccaccatgcccagcataaaattgctaatttttgacataaggcaatttctttctttttttgtttgagatggagtctcgctcagtcacccaggctggagtacagtggtgcgatctcagctcactgcaagctctgcctcccaggttcacgccatgctcctgcttcagcctcccaagtagctgggactacaggcgcccgccaccgcgcccagctattttttttgtatttttagtagagacggggtttcaccatgttagccaggatggtctcgatctcctgacctcgtgatccacccgcctcagcctcccaaagtgctgggattacaggtgtgagccactgtgcccagctgacataagacaatttctaatccaccactgcactgtctcaaggaagacatggacatagagccagatagaaatggtcatgtctctcatttaaatcggaaacatggaacatgggagaaaacaagtatgtggcagtgtttcagagacaggctccctaggttagtatgggtgtgacagtagccctgtggactccccaccgtgccggactctcagaggcacctgcaggactgtgggcctcgaggacagaggggaggtggcagtgtgaggatggtgtggtcggagctgctcagagcttggaagaggaagaaaagggcctcccataagtaaggccagagttgtgggcatttcaggtctgccaaactccagaacgtggtttcctctggctgcgggcagcacacagtgtcaggggtcagaggcatcaggaattggatgcagacgagggagttaacaagggaagagacagagaaggccatagcatggagtgggcagaagtgaaagatcggagcaggcagagcggggcctaccagaagcagtatctgcttctatcagcttcttcagggcagatatccaaaggagaggggaaaggaggaacgcagctttgtgaagaaaggaagagggcttgccacagggatcctttctatcaagatgagaagatgtgggcaagtccctgcgtgtcagccccaccgaggaggatgcagggggagcatgtgcataggcaccagcgtgcacatcgatgacagtcccaggaaagcagggacccacaggcgtgtcatgaaggaggagaaaatggggctacctgggaaagaaggcgttacttgtaaaagagctgggaggtccagtagggccgggctgggatcccacggagcaggccaagagtaaacagggccccatctactcagggacacagtggctaacgcaaacgctgttgtggccttggccagacaaggaaagtgatgcatacagtctccagaaatgaaacaagcacattagggtgtattcgggggaattgtgtttaaaattaaattctatcagagaggatgagtttaacaacaacatattaggagcttctcacatttttaagaaccccacacaaatgtcatagctgtcccggctccacagccatgcgagggtggggacccaggacgcctgggcacctgggcagcccatgggagcaccggccggtggtgacgaagcaccatgcagtggtctgtggactgcatggctctgtcctcttttctaaaattaaagcttacaaaccagtaaggctgggaaataaactgaggctggcaggcaggcagccacccatgtttccgggatccaggatgaactacggaaaaacatttgggctcatgctgtcagtatgataggtgcagacagatttcctgagctcctaagaggaggagctgaaggaagatactggaagaggaaaggagaggagggagaggaatttatcatttggataaggggaagaagggacaaaccacctgcccagatgagcgagaacaagcagggagaacaaataagacagcaaatcaactccagaagtctctgttcatctgaaaaccacaacagaggaaaagaaagcatggggagtggcatcgactatttaatgccgccccctccccaaattcatactttgaaatttttcccctgaagcgatggtgttaggaggtggactttgggagtgattaggtggtgagaataaagcccacaagaatgggactagcgcccttagcagagacacttcagagagacccctcaccccttccaccacatgaggacacagcgagaagccatcctctgtgggtcaggaagccacatgttcccagaatgcagaagacggccaagtgcttttcaaactatgtactattagaaagtgatggctataataagcaaactctgaagaatcaagtaagttaacatgaccaaaaaaaatgtttagaaacagtgaaggtgtcagagaaattcagaaattattattagttaagagtcctcaaaaattcttttctatttcctggtgggaagtgagctagccgtgtgggatgaattatttgataagatgctatattaaattcatattttttaaaagtactcatgctatgtttaatttcctttagaactccctgatcataattaaatttcaaagcttttacaacaaatctcttttgcattattttcccaaacaaaacaagaaaacacaaggacaaaccctactgtgaagcagtggagactggagtcctgcatttgctgaactttctttttatgtgttggattctgattttatattcatttccattcatgtggactctgaagagttaaactcactaaggacacttgaagaagtcacgtccagggatcactgtcatcacagatggagaaaaggccaatgtctttccatgctgcctcaccagaaaaggactgagttggtacagaccttcattccagcttaatgtccatgacctcatcacactccaggcccaggcttgagctacatgttctagaaagcccttaacttctctaggtctcaagtctaatctctgcatctgcgccaggttccctgagactactctaaagcttgatgattcactaggattcacaggactcagaaaagcttacttttctgaattagatgtactgttctgatatattacagcaaaaggatatgagttcaaatcagaataaaataaaaggtacatggggcagagtccaggagaaaccaggtgaaagcttccaggtgttctttgctagtggagtctcacgggctctattaattttcccagaaaccatgttaccaaccacggacgctcacccatggcttggcgtccagggttcttactggggaataatcagaacttcaaaggtcataggtaagcatttgaaggtagtagaactcaacctaatcttgctgcaggacaagtactgggtacctcaggctgtagaaggttcttcctcctggaggagaaggggaattggctttgtactgacccttggattagaagttaagaaagagtcagctgtcaaaccacaagccacatgcaaaccagttggcagttgggttctccccgctctttgatgtctgaggaagacaagctccaacctctgtctcatcctagtgcaagaccacaatctgcact

SEQ ID NO: 465270 - DNA, 1209 bp, Homo sapiens
cggaatctcaccctgctgccaaggctggagtgcagtgtagtaccgggcgtcaaagcagaacgctttgaagaaggaatgacggtaaagcactgtgcattgtccctcgtgggagaaccaataatgtacccagagatcaacaggtttttgaagctactccaccagtgtaaaatctccagcttcctggtcacaaatgcacaatttcctgcggaaatcagaagacttccgtcagtgattgatggagggaggtggcccagcagcacagaccccatgtggaacctcgagccagttactcagctgtatgtcagtgtggatgccagtaccaaagacagcctgaagaaaatcgaccgcccactcttcaaggatttctggcagcaattccttgacagtttaaaagccttggcagtcaagcctatttctgatctagtactacccaaagaagaagatgggatgacccaagaagtgcctaaagaaggcaaagagggagcctgcgggaacaaaagtgttgaagatttcaacgtgaagcacatagagagtgagtctgggaagaatttgataaagatattggttcaattccatgcaactcaaggaaacagtgagtttccagaaagattaccaagtaaaggattttgatctctgtttacattgtccatctgttcttgtgtgctgtgtactttatccactggagccctttgcatctggtcgggttatcccaacatccctgccgtgtcagagcctggtttggatgcttgtgctatctctttaaactttgctttttgccttttagtgtgccttgtaacttcttgttactgaatgtgatatcctgggtaaaaggaactgctctcactagacctttaataatgtgatggtatggtatatggggaagggaagcattctgtagtcttatgattaggtctcagtgttttgttttgttttgttttgttttgagtcggagtcttgctctgtcactcaggctggagtgcagtggcacgatctcggctcactgcaacttctgcctcccaggagaatcacctgaacccgggaggcggaggttgcagtgagccgagattgcgtcactgcacttcagcttgggagacagagagagactccatctaaaaaaacagacggccgggtgcggtggctcacttctggaatcccggcactttgggagactgaggtgggtggatcacgagttcaggaggtcgagaccat

SEQ ID NO: 465271 - DNA, 903 bp, Homo sapiens
aggtcctgaacaccactccttgcaccatggctatgaacgggggaaggggtgtccttgggaatcactactggttgcagcccgatgagataccctcatatccactgctctatggaacatgctcctcctgggtgttcctagggatgggtttggggcaagtgggcatccatgtcctggggctccacggcctgcactgtctgcagccagggtgtctggggctgggaaagagccccaggctaaaggatggatggagactatgtccacccttttgggagaataatctccaagaatttcaaagagatggtggctggcataatgaaatgaaagcagcagcctctgagaagcagaaagaggagtctggactaaatgcccatctggcgttcccaccctggggttcccatcccagcccagccaaatgtgctaccgtttggtgacgctgctatattaactaaaattagcaagtgacctctgcttcaaaactatgttaggtcaaagcacttttgttatatctacaaagaatattttcccttaccagtttcacagttgtgccagctttcccaagttctaaaaggcccttggcatttaggagtagagaagcaatgatttatatagtttctgcatcactctcagccctacttgataggaatcaagggtgttttaaagaggaaaatgagtggtgtcggtgtaacaaagcaatttggttctgttgttggtcagcccgtgttacattttaatctaaatttgcagctttagtatctaaatgaaagtttgctttcaggtgtattttctctgattgtttttcctctcagataatgctactgtaatggaaactaagccagcctctttgccatctctttgtagctacgatttatttttccaaataaaaccatattgactatatatatg

SEQ ID NO: 465272 - DNA, 4966 bp, Homo sapiens
gcggttaaatgtcaggtctttcttctttaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcaggcacggaggattttggatttgggaatttctacaagtcaggagagcctctgtccacgtggtgtgggagccccccgtatgccgccccggaagtctttgaggggaaggagtatgaaggcccccagctggacatctggagcctgggcgtggtgctgtacgtcctggtctgcggttctctccccttcgatgggcctaacctgccgacgctgagacagcgggtgctggagggccgcttccgcatccccttcttcatgtctcaagactgtgagagcctgatccgccgcatgctggtggtggaccccgccaggcgcatcaccatcgcccagatccggcagcaccggtggatgcgggctgagccctgcttgccgggacccgcctgccccgccttctccgcacacagctacacctccaacctgggcgactacgatgagcaggcgctgggtatcatgcagaccctgggcgtggaccggcagaggacggtggagtcactgcaaaacagcagctataaccactttgctgccatttattacctcctccttgagcggctcaaggagtatcggaatgcccagtgcgcccgccccgggcctgccaggcagccgcggcctcggagctcggacctcagtggtttggaggtgcctcaggaaggtctttccaccgaccctttccgacctgccttgctgtgcccgcagccgcagaccttggtgcagtccgtcctccaggccgagatggactgtgagctccagagctcgctgcagtgggtgagtgcccacagcgggtgtgcagagggctcgcctcagcccagccctggtgcccccggtgtgcccggctgcagcggagtgttccggccccggcccgtgtccccaagcagcctgctggacacagccatcagtgaggaggccaggcaggggccgggcctagaggaggagcaggacacgcaggagtccctgcccagcagcacgggccggaggcacaccctggccgaggtctccacccgcctctccccactcaccgcgccatgtatagtcgtctccccctccaccacggcaagtcctgcagagggaaccagctctgacagttgtctgaccttctctgcgagcaaaagccccgcggggctcagtggcaccccggccactcaggggctgctgggcgcctgctccccggtcaggctggcctcgcccttcctggggtcgcagtccgccaccccagtgctgcaggctcaggggggcttgggaggagctgttctgctccctgtcagcttccaggagggacggcgggcgtcggacacctcactgactcaagtacgtgactttgtccgtgatggcagatggcaccccctgttctccaccgggcctgggtgggaccctcagtgctctgggcaggctggggtgctcagtgctctggtggctcggggcgtcacggcctgctgggatagacacacatgggtccctgagcacgcggcctccatggctggttctgaaagcacaggagacgactctgtgctgggcagcacctcccgacttggaggagggagggcccctggctgccggctgcctccacgccatcctggggcttaggtgccagactcctgtccagacgtgcttgtgtcacccgtcctttccttacccccaacctgaggcttggaaaccccttaagccaagggccgtggatgctgggctgagagccgggtggccgttgacctcctgattcattctccctgcagggctgaaggcctttcggcagcagctgaggaagaccacgcggaccaaagggtttctgggactgaacaaaatcaaggggctggctcgccaggtgtgccaggcccccgccagccgggccagcaggggcggcctgagccccttccacgcccctgcacagagcccaggcctgcacggcggcgcagccggcagccgggagggctggagcctgctggaggaggtgctagagcagcagaggctgctccagttacagcaccacccggccgctgcacccggctgctcccaggccccccagccggcccctgccccgtttgtgatcgccccctgtgatggccctggggctgccccgctccccagcaccctcctcacgtcggggctcccgctgctgccgcccccactcctgcagaccggcgcgtccccggtggcctcagcggcgcagctcctggacacacacctgcacattggcaccggccccaccgccctccccgctgtgcccccaccacgcctggccaggctggccccaggttgtgagcccctggggctgctgcagggggactgtgagatggaggacctgatgccctgctccctaggcacgtttgtcctggtgcagtgagggcagccctgcatcctggcacggacactgactcttacagcaataacttcagaggaggtgaagacatctggcctcaaagccaagaactttctagaagcgaaataagcaatacgttaggtgttttggctttttagtttatttttgttttatttttttcttgcactgagtgacctcaactttgagtagggactggaaactttaggaagaaagataattgaggggcgtgtctgggggcgggggcaggaggggagcggggtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtgcattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaaccttgactttttcccttcctctctctctcatctctctgggagctctttccttccaagcggcttccctgagaggccacatcctccaggcttgtagaagtttcaaatcttaaagaggagggcagggagccaactcctgcattccacctcactgcagggaa

SEQ ID NO: 465273 - DNA, 520 bp, Homo sapiens
agacgactctgtgctgggcagcacctcccgacttggaggagggagggcccctggctgccggctgcctccacgccatcctggggcttaggtgccagactcctgtccagacgtgcttgtgtcacccgtcctttccttacccccaacctgaggcttggaaaccccttaagccaagggccgtggatgctgggctgagagccgggtggccgttgacctcctgattcattctccctgcagggctgaaggcctttcggcagcagctgaggaagaccacgcggaccaaagggtttctgggactgaacaaaatcaaggggctggctcgccaggtgtgccaggcccccgccagccgggccagcaggggcggcctgagccccttccacgcccctgcacagagcccaggcctgcacggcggcgcagccggcagccgggagggctggagcctgctggaggaggtgctagagcagcagaggtagggcctgcccccgccctgggaccccgggtgggcacacggcaggttatctcc

SEQ ID NO: 465274 - DNA, 2987 bp, Homo sapiens
tagtgtggaacctggggagcggggagtcaccataacaacggtaatgcaggcgatggggagtggtataaatacagatgaagcttctctcggtcacctgccactcaccttctgctgtgtggcctggttcctaacaggccatggaccagtactggcccatggcctgggggtgaattttgtggtatgccagcttgttgctctgtttgctgctttctggtttcgcatctacttacgtcctggtacaaccagctctgatgtccggcatgcggttgccaccatttttggcatctattttgtcatcttttgtttcggctgcaatgggatatcttacaatatgccacatcagccgaatatacatcttccactatggaattctcactacggatttttctgggattggatgatcgtcttccacactgacgagggtggatcttccttattcagtccatggattcaaatgctaatctcttttggaaaccctcataggcctctgatgattgtcactcagaagatcacaaccttggcattccaggttcatgatggtaagaacagcagccctccttttggttctcagagattaggtcgaagagctgaagacctttctgctgaacaacatcgacttgctatcaagaactcaggcctggttgccaaagcagacaacaggctgctactgcggttcttctgcgtggcctctttcagtggaaactgtgtcatagctggtccttgtaacaatttcaaggactacatagccttcattgaggggaagcatatacacatgaagttgctggaggtgaactggaagcgaaaaggtttccacagcttgccagaaccttctcccacaggagctgtgatacacaagttgggcatcaccttggtgtctctccttttgtttttgacgctaacgaagacctttcctgtcacctgccttgtggatgactggtttgtccataaagcaagctttccggctcgactctgctacttatatgttgtcatgcaagcctcaaagcccaagtattactttgcatggacattagctgatgcagtgaataacgcagctggctttgggttcagcggagtggataagaatgggaatttctgttgggatctgctttcgaacctaaacatctggaaaattgagactgccacaagtttcaaaatgtacttggaaaactggaatattcagacagctacttggctaaagtgtgtgtgctatcagcgggttccatggtaccccacggtgctaaccttcatcctgtctgctttgtggcatggtgtctaccctggatactattttaccttcttaactggaattcttgtcacattagcagctagagcggtcaggaacaactacagacattacttcctttcttcaagagctctcaaggctgtgtatgatgcaggcacctgggccgtcactcagctggctgtctcttacacggtagcaccctttgtgatgttggcagttgaaccgaccatcagcttatacaagtccatgtacttttatttgcacatcataagtctcctgataatactatttctgccaatgaaaccacaagctcatacgcaaaggcggcctcagactctgaactctattaataagagaaaaacagattgatacctccaagagaagcggaacaagcaaaactgcagaacgttcgaaagatgagatgacaaggcttcaagggctcctccggtggcttagaggcgatgtttacatgcatctttattttgttcttttttaaagtgcagggatttcatagctgagaaattcagctttgttttagttgaatcatcatattggaaagcagacattgaaagttttcttttctatctttgttatgaatgtgctatggccccttttggagacttctattgggtaatattctatgtgagagaaggaaacttggtattaaatgttgtggaaaataataatgatgataataataaagtatatgctgcaatggtgtactgccaatcagattgcttgggagaagaaaatttattcaaatccaacgataaaaaattaatttcttattgaataaacagtatgttcccatataaaagaaatgtttctgatgggaataattgctttttgtctgtgtcaatagagacacaggtccataaggtgtcctactgctgcttctcttaggatagtgaaatgtgaatgtgatgtgcctgttcctctacagcatgtaaacagtcctggtgctgggggagaaattagtttccgaaataaaggcttgtgttttcagggaattctgaaagtacattacgtgatataattactcaggcagccagtttacatagtctgaacccctctggtccacccttccattaattaatgcattcacttatttatcaaatgtgtcatgtctggaacaccagttattcttaggtttggatatttaacacagtcccaaacttcttaaaggctatgttcattttttaaaaaattattttttccttgtctttaatagattgggttaattcaaagccttgtcttcaagctctgaagttttttcttatgcttgttcaattctattgctgaggctttccagtgcattttgcatttctctaagtgtgtccttgatttccagaaattgtgattgttttttatttatgcagtctatttcactgaagaattttcccttcatatcctgtatcatgttcttgatttctttaaattggacttcaactttctctggtggctccttgattagcttaataattgactttcttgaccttattcgttttctgtcaattcagagattttgtcttggtttgattccattgctggtgagctggtatgatcttttgggggtgttaaagaaccttgttttgtcatattaccagaactgtttttctgattctcatttgggtggactctctcagagggaagatctagctacgactcaagggctgttgttcagattcttttgtcccatggggtgctccttgatgtgatgttctcccttcccccaggaatgggg

SEQ ID NO: 465275 - DNA, 1869 bp, Homo sapiens
tggtaaaatcaattgtccccagcagttgtccccagccttagaactcaaggtgacaactgacaacattctagatgatcgagccatgtccttgggaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagaataagggctgcggcatttttgaggtctcctcattgctggctgatcttgctggtacaggtcctgatgtctgtgacctgtgttcatctgctactgcttctcgccttggaaacacagtgactcatcctgcatgcccaactggctactgcccagagtccagttctatctgttctgctcttaacaatggctgcataagtactttttgggtctaacaagactcagtgcactctccctctttccaactatttcacaagtcctttattcccaaataaacttaccaagttcttacagattcttttccttataaggtatacatccctatggctgaagttgaatgacagcctctctcaggccatgacaggatgacaaggtgagctacaaggaaactgcagtgaagtttggctccaagcatgacacagacatgggctgaccttgaagaaaaaaaaagactaaacgctacctacgctcaatgttccacacctcttaagccagtaatcctgtatctggtgtcgggcagcaaagaaaataaaatatacctcgtctgtgctccatttggaaactttactggcagggattcctgcgacagttggaagaagtttgctttgctgctcccagcgcaagggcagacatggaattggggacttaaaggacagaaagacagctgaccgacgctgtgcctgctggacggtgggttcttcccgggcacctggtcaatgaaaacaaatgggaaatcactctctgaaagcagcaagaaagccccaaatgccgtgcatctcccagataacgagactggaggtgggagtggttaaagcattggttcctttcagcattatactattgaataggctcttctttgtctttactgaaggtcactataaaaaacaacctgtaaattcaactgatatcatttgctacagcactcattactaaagacatgcttcattatgttgttcaacgttgtctctttaatgcttcagataagaaacgtgcctcaaagttttaatgggaaggaaagttagtcttattctaggaagttgtttatttgctcccctttctgctttggatgttgtaaaggtaacagccaagttgcatctcacgtctaacacctgtgcttaccatgtattcacagttggcatactttctctctccttttgtctcagggcttggtttggttttttaacttcttatttactaatcatactgattttttaaatagccaattcaattttttgacagggatatgaaattattgcaataaaaataaaacagcagaaatgcaaatgtttttgtaattttttacttgttcagatcaaaattaaaactactaaatattcttactgtagcctgggcaacaagacaaggtcccatctcttgaaagaaaaaaaaaaaccctactgaatattctatttatgttagagcttctgaacccaaagctagttttatggctgctttcctaaaacggccattctctagcaaaggatttttgtcctctggacgcttgacttagagctgtcaatcgtcgtctccttatggtcctttagaacagaaaccttttctgaaaactctgtattcaaagca

SEQ ID NO: 465276 - DNA, 619 bp, Homo sapiens
cccaccctaatggacctgtttaaaggccctgtctccaagtacagccacattctgagatactgggagttagggcttcaagatacaaattttagagaggcccactccagcccatcacaaagacataagggaccagagagagaagcatccctgctgatgagaaagaacagacactcccagaggacaaggtccacctgtcaggcagccacagcccagcatactctggagtctgaggtgggggtcagttgtgaagaaagggaagaaggaagaaaaaggatacgttgtgctccgaccacaggccaaggtacaaagaagaggggaaaagaaaatagctgggccctgagactcatacctgtaatcccagcactttgagaggctgaagcagaaggtttggttgagtccagagtttgagaccagcctgggcaacatagtgaaaccgtgttaaaaaatacaaaaattagctgggtgtggtggcatgcacctgtagtcccagctactcaggaggccaaggtgggaggattgtttgagcacagcaggttgaggctgcagtgaaccatgattgcaccaccgtactccagcctgggagacagggtgagacactgtctcaatcaatcaatcaatc

SEQ ID NO: 465277 - DNA, 439 bp, Homo sapiens
cccaccctaatggacctgtttaaaggccctgtctccaagtacagccacattctgagatactgggagttagggcttcaagatacaaattttagagaggcccactccagcccatcacaaagacataagggaccagagagagaagcatccctgctgatgagaaagaacagacactcccagaggacaaggtccacctgtcaggcagccacagcccagcatactctggagtctgaggtgggggtcagttgtgaagaaagggaagaaggaagaaaaaggatacgttgtgctccgaccacaggccaaggtcagaagacggtatttaccaagtctcttcccaaaatacttgcaaatgcacataatctcaaagtgtttttgagggctcttccgatctaaaattggtcctagtgacaaggggtgtttggggaaatcaaagggctggctt

SEQ ID NO: 465278 - DNA, 993 bp, Homo sapiens
cacagatttcagagaaataggatcagtgctctgaagttaaaagttaagtttttgcttatataggaagaagacaaagaaatttaacaggattatatttcctatatactggtttaagagttataacaaattaattagttagagtttgttttcttttctgtatggcttgttttattcatagctgattttcatttcctttccaatttaaaagagtatgtttaacattccatcttaagacaatgtggtagtcatgaagtctttgtgtgagaaaggtgagagggaggttaatctacaatgaagatcaacagaggagaaggaaggggtcttccttggtgcccttctgtcattcatgtcattttattaacacaaaacaatacaggcactcccttgcattgctagcttatctaattatgcttgcttagaagttccagagattgaatcttgagacaatccaggtgcctatggaattatcccccaccaggagattacttcaagcctgcagctaatttacaacccagtcaagcccgagatggcaccagctcattcacaagttggagcaataactcaagagggccatacaactttcattgggcatttaaataagcagagtatgctcctggacaactggaaggacaccattgaaggcactggttattttaccaaggctttgactggaatggcatggtttcagttataaacagactgctttaaggaatcaaagttgacttacagagctgataaaaggcccctaagaaaaactggcctcacctcttgtctatatagtccctatataggtttcctgacctgtgttttttgacttggactcaataaaattgctgctacctttttactgaggccttacaagctaaagcttattccttgagacacagaagttccagggattgaatcttgagacaatctgggtgcctatggaattatctcccaccagaagattacttcaaggcagcagctaatttacaacctggtcaagcctga

SEQ ID NO: 465279 - DNA, 926 bp, Homo sapiens
aggagtggcttgacaggatttaggaactgattggatatgacatggatagaaaaataacagtgttttccctgctctctactctcagtcactcagtgcaacacttctgccaccagttgtacaggggttttccccacatgaagcaattcttaccccacatgaagcaatttcatgtcctctctgtctcctccaggcacctccatgtgttcacctatgtggaagctccccaaacccagctacaaaatgttctagatggtggctgctcctttagcaaggatccaagtcaggatgacagggacacaaaacagagctcctggctgactagcaaagggcacctagctgacattatggccaaaaccctggggaatttccctgaaactgacagttttgtcctggggaacctccctgctctttctgccatggcactggctggcttctacacttcactggtacaaagaaagtgacctctgaaatttgaaaactatttgtaagtatacttaatttatggcagtatgtttatttctataagttcaataaaaatctgttttctttttttttaaacaggacaccattgaaggcactggttattttaccaaggctttgactggaatggcatggtttcagttataaacagactgctttaaggaatcaaagttgacttacagagctgataaaaggcccctaagaaaaactggcctcacctcttgtctatatagtccctatataggtttcctgacctgtgttttttgacttggactcaataaaattgctgctacctttttactgaggccttacaagctaaagcttattccttgagacacagaagttccagggattgaatcttgagacaatctgggtgcctatggaattatctcccaccagaagattacttcaaggcagcagctaatttacaacctggtcaagcctga

SEQ ID NO: 465280 - DNA, 654 bp, Homo sapiens
atatttggtgaattgttggttctttttgaaaacacaactgcatccattcattacaatctctatatctgttgctttctttatagggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaatatccttgccatagtttagtctttaaggatgcttcatgttgttagagcattgaaaactcattttgtatttagaagaagatagtctcatcatcagtctttcccataatagcatctttgccttcacggactcatttatttacaccaggcatggatgtccactatcactactatcattt

SEQ ID NO: 465281 - DNA, 1695 bp, Homo sapiens
gctctggctgggaaccacagttactgaattttatggttagaggtcttatgtttaagtcttttatctatttcaaggatgatgcaacagaagaatcagaagcttttcaaaattccgtcttcaagaagaaacacccgtggaggaagaagacattatacaaaacaaatttagaaactgtatgtatagcttcatgtttttcataaaataggaatgaggacaaatgttgctcttcatcctaccagctgtttgttctttggtaggggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaatatccttgccatagtttagtctttaaggatgcttcatgttgttagagcattgaaaactcattttgtatttagaagaagatagtctcatcatcagtctttcccataatagcatctttgccttcacggactcatttatttacaccaggcatggatgtccactatcactactatcattt

SEQ ID NO: 465282 - DNA, 1611 bp, Homo sapiens
gctctggctgggaaccacagttactgaattttatggttagaggtcttatgtttaagtcttttatctatttcaaggatgatgcaacagaagaatcagaagcttttcaaaattccgtcttcaagaagaaacacccgtggaggaagaagacattatacaaaacaaatttagaaactgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaatatccttgccatagtttagtctttaaggatgcttcatgttgttagagcattgaaaactcattttgtatttagaagaagatagtctcatcatcagtctttcccataatagcatctttgccttcacggactcatttatttacaccaggcatggatgtccactatcactactatcattt

SEQ ID NO: 465283 - DNA, 1522 bp, Homo sapiens
gctctggctgggaaccacagttactgaattttatggttagaggtcttatgtttaagtcttttatctatttcaaggatgatgcaacagaagaatcagaagcttttcaaaattccgtcttcaagaagaaacacccgtggaggaagaagacattatacaaaacaaatttagaaactgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaatatccttgccatagtttagtctttaaggatgcttcatgttgttagagcattgaaaactcattttgtatttagaagaagatagtctcatcatcagtctttcccataatagcatctttgccttcacggactcatttatttacaccaggcatggatgtccactatcactactatcattt

SEQ ID NO: 465284 - DNA, 1567 bp, Homo sapiens
ccatttcaattgtctacacatcatttccacagtgttgagagccggatgcaggtgaggcccaggcctgtggtggagattctggaatgcagctgccagatgaaaaggaagactagggacaaacgaggtggagcaggaaagagaaaggagaaaacatgtctgccagcccatagatatgaccctggggccctgggggaaaagagaaagcaggcactttcccatcattacggctgcaccaccgcagccatccccaccggcctgcagggagcgccgctgaccctgggccaaacgtcctgtagcacaaaattcctttccaagttgaaaggaaaaaatgaatgggctgcatgcagccagcctccaggaacagggaaaagagggtccttctccttcaggagtatcccctccactaagaagggtgtagaaggagcagaaaatgtcccacactccgaagctctgctaccacgtggccctccttttggggaggagcatggttggaatgagagcgaggtaagaagatcccagccaaatgtgactgttgctgagggtgaggggaaggttgggaaaggggagggagatggaggccaggaaacctgctaggtggcagtaattgcaggtttgcctgaaattttcatcacaattctatatttcaagtacttcgcctgaaagaaaatatttttttcctttggtgcttactgaaaatttagcaaacagtaggaggtgatttagtgtgcctggcatatgtagaaaataaaatgctttgttattttcatgtctgaatacaaaaatccatagaggctacacttttcagacattcttgatgattgccattgtacaagaaaaattattttctttacttctcagtccaacaaagatcagcattccagcaatcaaggaaggaatcaccatacttgcagatgtaattgacgttggtcactgagggaggtagaacaggcattacataatgagggcaaaaaagaaatttggtcccccaagtgatccagtgacacatctctcagtatgctccagtccaaatttgacaagaaataggtttcctcaagaagagcgccagccacagttctggagtatctgttcctagacggaggtgaatgcactagatgaagtgcatgaacctgaacaacttgagggaaggacagtagtagatgctgggctgctgtcaagatcccccttacagttggggcacccattcatccagctgcccgggttgttgaagggtagtgatggctctcagatgactccctgtcctgaaatatcctcagccaagggaaactgactcatctaaaattttgccccctccctgggcacaggctgcacccatgactagtctttctggggacacaaagacttgattcccttgtctcaattgagacaattctcacggctgtctcaagtccagagctccctgtcagcctctgttgaaactgtattgcaattcaactgctccatttgccaagttctgcctttgcttctccctttgccccattctcatctttcaagatctttactcgataaatattttgcataaaaagctcagggttgtggagtctgtttt

SEQ ID NO: 465285 - DNA, 1144 bp, Homo sapiens
tatactatattgctgacattatgttaattggacttggtgaacaggaagtggccggtactctggatgtcatagtaaaacatatgaaagtgaaacataaatcatttacagtatcaaagtcctgccatattggtgaagattttaggagtcccatggtttgcagcatcctaagggccttctcagaagacttctcagcccatttggcccaggatcaacacagcccagaagtgcaggggcattaccacgccaggggcaatcctccagcagtgggagatacaagcctatggatgaaggttcccacctcccatcactcagatgagaaacaccaagaggcttcttgtacctttctcagaggccacagcaggatcaatcccccattgcacacagcagccatctcaataatgcaccattctattagttaactgctcccaagtcctgccccatgttctactttcaggagttcccaaactaaggcaatagctgcacctgcaaagaaagcgactacttgttaatatgtgatataatccagaaaagcaagagtccacccaaagtcagaagagaagaattcagaagagtaagagcgtctccacttggtcatctctaacagaccggaccccgccactttgctaggatatcccagaggagaccagagcagaattccctgtgaagatattgcaaatgctgcaccactttgacacagacgaatattgccttaatgctttctcattgcagctccattctcattcctcttgttctaatctcactgggaacagtaagaagctgccatcattttatgttatacttttacatactttaaggttattactgattaatgagaattaaaggaagctgagaatatataaagcatttcttatttgcagtttttcactccatttgatatacagactgtgtatatcaaatagatttacaaactgtgctacaatatttttttctcttattggtaggggctgaatcagactcccctccccctgcaagaaagagatgttgaaatcttaactcttggtacctcagaactgacttcattaggaaacaggattgttgcaaatgtatacttaagatgaggccatactggcgtagggtgggccctggtctaacatgactgatgtccttacagaaagacagccac

SEQ ID NO: 465286 - DNA, 805 bp, Homo sapiens
tagctggcctcaagagaagggcggtggctcgcacggcgcgggcggctttgctcactgcagctggggagatgcaggtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaagaagaaaacatcgaatgaaacttgctgaagacagtaaggcggacgttactgagaaccttggagatagctacagggactgctgcatggggtcacgggagagagattgggctcaacttcaaatgcagcatgggcggatagccaaggagcaggatggggctcaatggatggaaaattactcgaggaaacatcagggagaggagaggggagtattcaaagtgaaagtgtacacttgtatctaaaacgactgttttctaaatatccaaggcaagtctggaaatttgagtcatcttcacttccttcccctttgcccagtattctgcacatgttcctgcccttctacctgcatgggctggttaaggataactgtatgaaatattagcatttgcaattgggatggtttttagaggtggatgatgcttaaaaaaaaaaaaaaaaaaaggaaatcattgc

SEQ ID NO: 465287 - DNA, 1118 bp, Homo sapiens
ccgcattccgatcgtgagaacatcctgggcacacccaaactgagagacaccatacaaagtgactggtcagtgcactcaaaggcaaaaagctcatggaaggcaacagaagacaggagaagtgacagctaaaagcagcgtggaatcctggaagggacaaagaacacgagcagagaaactgtagaagctgagtgagggcagcggtccagcttgcgctgttttgctgggcctcaggttttccttaggattccgtgtgtgttccccgcctggcccctccgcagcgactctgctgtcagtggctgccccagggtggagagtgacctacctccggcttctcctgtcccggcttctcctgtgccagccggtcaggcacactgtaagatccccacagcggggtgcccccaccctcacctggaccctacaccatcaccatcacaccttctcgtgtgtcataaaccccacaacacattgttatgatttttgctttaaatcaattatcttttaaagggattaaaataatgtgagctgtgaagttggtatgttaaaagtggaagagatgccacagccaaacccaaacgttacagtatattttcagtgaattcatgcagttgccactgaacactgcagcgtagacaggaatgaatccgcagacgttaccaagagtgaaggaggccaggcatgcaaaggacacctggccagcggttatgcgtccctctagtttcggcatccagtacagcattgttaaccatggccacctaggacagcgctccccagaaactgaatttgccagcaccttgatcgtggacttccagcctccagaacagcgagaagaatcgcttctagacacaaagccagtcacctggggacgctgccacctgaaggcctgcgtggccgggtctgtgactgtagacacaaagccagtcacctggggacgctgccacctgaaggcctgcgtggccgggtccctctacaaaaggaggcaaaacttcctcccacagagccgctgttggtgtgtggctgggcccaagcaggcacccacagacagctcagccacggggccccctgggggcactgctggagtaggcagcagccccgggttggaggagcagcgcttctaggag

SEQ ID NO: 465288 - DNA, 1235 bp, Homo sapiens
ccgcattccgatcgtgagaacatcctgggcacacccaaactgagagacaccatacaaagtgactggtcagtgcactcaaaggcaaaaagctcatggaaggcaacagaagacaggagaagtgacagctaaaagcagcgtggaatcctggaagggacaaagaacacgagcagagaaactgtagaagctgagtgagggcagcggtccagcttgcgctgttttgctggggtgattctggctttgatgaccttgttttgaggtgacgagcgctctggccgggcccggtgtgtgctgattcttccctggccgctccacacagccctgttcctctgtcctctcttccagcctcaggttttccttaggattccgtgtgtgttccccgcctggcccctccgcagcgactctgctgtcagtggctgccccagggtggagagtgacctacctccggcttctcctgtcccggcttctcctgtgccagccggtcaggcacactgtaagatccccacagcggggtgcccccaccctcacctggaccctacaccatcaccatcacaccttctcgtgtgtcataaaccccacaacacattgttatgatttttgctttaaatcaattatcttttaaagggattaaaataatgtgagctgtgaagttggtatgttaaaagtggaagagatgccacagccaaacccaaacgttacagtatattttcagtgaattcatgcagttgccactgaacactgcagcgtagacaggaatgaatccgcagacgttaccaagagtgaaggaggccaggcatgcaaaggacacctggccagcggttatgcgtccctctagtttcggcatccagtacagcattgttaaccatggccacctaggacagcgctccccagaaactgaatttgccagcaccttgatcgtggacttccagcctccagaacagcgagaagaatcgcttctagacacaaagccagtcacctggggacgctgccacctgaaggcctgcgtggccgggtctgtgactgtagacacaaagccagtcacctggggacgctgccacctgaaggcctgcgtggccgggtccctctacaaaaggaggcaaaacttcctcccacagagccgctgttggtgtgtggctgggcccaagcaggcacccacagacagctcagccacggggccccctgggggcactgctggagtaggcagcagccccgggttggaggagcagcgcttctaggag

SEQ ID NO: 465289 - DNA, 2392 bp, Homo sapiens
  misc_feature (6)..(8): n is a, c, g, or t
  misc_feature (11)..(12): n is a, c, g, or t
  misc_feature (14)..(16): n is a, c, g, or t
tgcccnnnttnncnnngggcaatggtagcatggaacatgcaacccctagcttacttgaaagattggacttgaaaaaaatcagcagttccttctggaatctgcaaggattggggaatttgaaagattcaggggaattagttcggcttcccaaactagttggttttagtgaccccttcttcttcccagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttc

SEQ ID NO: 465290 - DNA, 1249 bp, Homo sapiens
cacagaatggcctggcacggtgaccacggagtgccctggcaccggtgcccgcggctgtgacggaaaaagggtgggaagaacagggaagaggaagcagaaacaggcactccttgatgaaataagtaagaaagcttgtcaagagccatcactcttgctcatgggacaagagaaggcactgacctgtgcccaccagcaccccatcactgagccaacaccaccttcaggaagacagtctccagcagggcttcccccaattcccctagctgctttgcctctgctactccggtaagcacctgcagggaggcaggcaccccagcacccactagcattctgcaacagctgttgcaccttggctcccccagtacagtggattccaaacctcaaggagtcaaagaacagatggggcccaatacaaattccccagaattacaacatgccgtccaggagttgagagctgagtgttgaccttctaaaatctcccagaaacaaagccaggtggctgaatccaccttatattatagtcaaaccctcaaggtcatcaaatcatcaaataggataaaagaaaaaaaaatccaaaggtcagcaacatccaagattgaagacagataagctcacaaagatgagaaagagtcagcacaggaaaactgaaaactcgaaaaaccagagtgccctctttcctacgaacagccacatcacctctccagcaaaggttctgaactgagctgagatggccaaaatgacagaaatagaattcagaatatggataagaatgaagatcattgagctacaggagtatgttgaaacccaatgcaaggaagtgaaaaatcatgataaaacaatgccagagctgacagacaataatggacagtatagaaaagactctagactaataaagaagaaaagagagaagattcaaatgaaaacaatcagaaatgatgagagggatattatcactgacctcacagaaatacaaacaaccaccagagactattatgaacacttctatgcacataaactagaaaatctagaagtggataaattcctggacccattcaccctcccaaaactgaaccaggaagaaattgaaagatacaccaaaaaaagaaaacttcagaccaatatttttgatgaacatcaatgcaaaaattctcaacaaaataccggcaaaccaaatccagcaacatctgaaagcctatccaccacaatcaagtaggctttatccctgagatgcaacgttggttagacatac

SEQ ID NO: 465291 - DNA, 318 bp, Homo sapiens
cacagaatggcctggcacggtgaccacggagtgccctggcaccggtgcccgcggctgtgacggaaaaagggtgggaagaacagggaagaggaagcagaaacaggttatctgttcactctgatggtagagaagaccttaaatgacctgatggagctgaaaaccatggcgagaacttcctgccttcgatttctcacaagctcgggcataccacgaggcttggagactcaaaacctgaagagcctgcaatcagatttctcccttactattcctgctcattgtcttctgtggactaatactgaacatgaaactttgcttaca

SEQ ID NO: 465292 - DNA, 816 bp, Homo sapiens
gggtggagctgcctgccagtcctgtgccatgcggtcacactcctcaacccttgggcggtcgatgggactgggcgccatgaagcagggggcggcgctcgtctgggaggctcaggccgcacaggagcccatggagggggtgggaggctcaggcatggcgggctgcaggtcccgagccctgccctgcgggaaggcagctaaggcccaggtgagaaatcgagcgcagcgccagtgggccggcactgctgggggacccagtacaccctccgcagccactggccagggtgctaagcccctcactgcccggggccggcagggccggccggctgctccgagtgcggggcccgccaagcccacgcccacccagaactccagctggcctgcaagcgccgagcgcagcccccaaaactggagaagaaagagccagggtagtcaaaggactgctcgttaattttaagatgtgcaggatgaagaggagaacaatgcaaggacatcagcagatcggcattggtgacatctgctaattatttggtttgactcgtgactggcatgagacttccatctgcatcaatcaatggaggcaataagcacagacagatctggaacccttgcctactgtgacatacagccgcagtagcaggcaagcctgggtcagctccagagcggcaatggagggaaattcccaggactctgggtgtcttggaagtttccaaggcctgcaactgatcacagatcctggttttcctcccattggctaaaaagataataaatacaagttacagcttgactactgtctgaaaaaatcttgtaatggttaat

SEQ ID NO: 465293 - DNA, 1384 bp, Homo sapiens
tcatccatggatattctaaatatatgcatgcaatttgtatgtatatgttttatacacagattttaagagaaagactgagagagtcaattcacaatgttcagtatgtggagcctccttttgatgactcaattgctgatataggtaaagaatggaagagtgccctggcaaaattaaagtttgctaattcatatagaatggagccattgaagaaattccaagctcattcagtagaaactaaagtccagcagatactaacagaaagtcttaaagatgtcaaatatgatgataaagtattctctcacttgtcacttgaattggcagaccgcatactgttagcagtcaaagaatttgggtaccaccgttataagttcattataaaagtattatttattcaaaagactggccaagcaataaatattgccagcagatggatctgggacattgcatgggacagctgggtcgcagctaaacacgaagcagaatcctacgtggcactggtcttggtgtttgccctttattatgaatagctcattacaggtactaaggattgtttacttccgaacttttcaaaaataaatgaaatttacatatttgtaaacctcataatatttctgatttgctatattcttattctcatttgaggcctttcaattgtattattttaacaacaaagtagaagccagatttttatatttatacttactgttatattaactaacataatattatgccaaagtagtataaaaggtgtatgcatgtgtgtctgtgtgtgtatatatgtatgtatatacaaattcttatagtagagtatagggaaaatatcatttttgtaagatttaagaaaatgataatttgctacaggaaattaaaatgcaaccttgtaaagtatcaaattcagtagatgttaagatagattttggaaatttctaatgatattttaatactttgtattcattgttttgaaaggaattaccaagtttgaaagaaagatgttattatatttcataattccctaatatcctcccgctccagccaaactgcttacaagtgtgtagtcaatttactaatctattaggctctgttaggctctgtgagccttctaggatctttttttcagatgcaagaactgaaaattcatattaattgtttaaagaaatgaggaaaattttatttcccagggatttgatcaaggatccaggttctctccaacttcccattctccccacagacttccacgtacattcattttgcttgacagaatttaatcatgttcctatgactagaccagttgtaattccctccttaagattggggctggagcctaccttttctgaagcgtgagatcatgtgaaaagtgtggctatttgccagccacagtggctca

SEQ ID NO: 465294 - DNA, 825 bp, Homo sapiens
aagggagtccctgaccaaaactctggtgcttctgaattgttaaagacagggttgcaacttaaaatttggaaataagtacaggccagaagaatggaagtaaacctcccccttataaataagaagagtcattcagaaatagagtgttgcaatgaagtccctgactctgaagactgactgtggagttcaaatcccagctgcactgcttactggctatgtagaagtccttctgcctctatatattttccttatgtgtaaaataataataataataactattatagtgttgtgaggatttatacaattctcatgtaaaataagaaagaaaaataaactcatgctaatctctatgacacacgtagttcagtgccctgccacataataagcacatgggaagagtggatagccatgaggattatgattattcacaacatgaatggcacccccaggcattgtgtttgcaaacttattctgaactaggaaatgcctccaccagtgatacccaggaaaacagggtctggagtggacccccagcaaactccagcagacctgcagaacaggggcccgactgtgagaagaaaactaacaaacataaagcaatagcatcaacatcaacaaagaggaccaccatgcaaaagcttcatctgaaggtcccaacagcaaagaccaaagcagcaagggaacaaaactggatggagaatgagtttgatgaattgacagaagtaggcttcagaaggtgggtaataataaactactctgagctaaaggagcaggttctaacccaatgcaaggaagctaagaaccttgaaaaaggttagaggaattgct

SEQ ID NO: 465295 - DNA, 388 bp, Homo sapiens
aagggagtccctgaccaaaactctggtgcttctgaattgttaaagacagggttgcaacttaaaatttggaaataagtacaggccagaagaatggaagtaaacctcccccttataaataagaagagtcattcagaaatagagtgttgcaatgaagtccctgactctgaagactgactgtggagttcaaatcccagctgcactgcttactggctatgtagaagtccttctgcctctatatattttccttatgtgtaaaataataataataataactattatagtgttgtgaggatttatacaattctcatgtaaaataagaaagaaaaataaacccagatgcggccaagccctcctctttttcttattctcgacgtgcactaaccacccc

SEQ ID NO: 465296 - DNA, 955 bp, Homo sapiens
tacaaggacacgccgagtcccatgagtccttctggtgagtctcagtctttgaaagtgaagggccctcaagagttccataagtctcagtgcaaggaggtgggaaaggctcctaagtgcttctgcggtggcagtggcttcctctggcaagggcaggctcaggaagaagaagctggtgaaaggcagaggcaacacctgcttcctgcagtaacctcagagccttaccagccagctctgcttcctgcctgcttttggaacgaatgtattcctggatggtggaatagaaggaggctacccctttcttcccaaaagcttcctaccacaagtagagcctcacagagcccgtcattgtttttgccaaatcattatcatctccagacaagaaggggcccccttcccggttttcaggcctactctcaaacctcagagatgagttccttgcccccagaccccttcatggtgagaggtgcagctctaacagtttccattccatgcattgagaaaggagtgattgctatcaggaccttagctctgatctaagaggagtattctctctttttctatttcttcaccactgctttctggaaaaaaatgtagggagagagcttggctctacttcagccacaggtgtttgcattttcctggcaaatcctccatatcctagctgtgaattcgggtattcttaagagagggaaaacaactttcattctaaaaacccactgcaagtaaataatttcatgttacttagtaaaccttgacatcccaaatagcaaaatctttcagaatttactcgcgtccacatagctcactattagtggatattggatttcccaacattccgtggtgtttcaaagttgaacaggtacataattacacttcagagtattataatttttcccaatgtcttttcatattagattaattcaagatttaggaggtagctaattctatattctgt

SEQ ID NO: 465297 - DNA, 5657 bp, Homo sapiens
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcgtcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465298 - DNA, 4816 bp, Homo sapiens
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcgtcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagtatgccaggtgaaaaaaaaa

SEQ ID NO: 465299 - DNA, 6101 bp, Homo sapiens
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcgtcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccaggtgagggaagtgggagagcagcccaccgcccccattaatacccatcctggtccagctctctgattttacacctttaattcctcccaaaggggccaaggctgggtggaagtatctatgaggatactccaggacagggatggggaatctccttgttcctgaaaacagcccctccccaccccagaaggcaccaagagattccttaattcctaacccctcccaggcctcacatcccttgtaaacaagtagcagatgttcacgttcatacacctccccacacacatttccagcccaaaccttctccggctcatcacctgactgccccaccatgtgcccagctgggaagggggcactgatgaccttcagctccactcttgagggtaccttgagtggatgctggcagggagggccactctgcatcgcttcctcttctgattctgttcctagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465300 - DNA, 4579 bp, Homo sapiens
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcgtcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggcactcgaaggggcctctgattgtggacacagtctctgctgagtctctctcaggctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465301 - DNA, 3916 bp, Homo sapiens
tgggagatgcacgctggcttctcccttctctactgtcatgccccgactttctgttcactccttcctcccacaggcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccaggtgagggaagtgggagagcagcccaccgcccccattaatacccatcctggtccagctctctgattttacacctttaattcctcccaaaggggccaaggctgggtggaagtatctatgaggatactccaggacagggatggggaatctccttgttcctgaaaacagcccctccccaccccagaaggcaccaagagattccttaattcctaacccctcccaggcctcacatcccttgtaaacaagtagcagatgttcacgttcatacacctccccacacacatttccagcccaaaccttctccggctcatcacctgactgccccaccatgtgcccagctgggaagggggcactgatgaccttcagctccactcttgagggtaccttgagtggatgctggcagggagggccactctgcatcgcttcctcttctgattctgttcctagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465302 - DNA, 1654 bp, Homo sapiens
tcgtgatccgcccgcctaggccttccaaagtgctgggattacaggcgtcagccaccgtgcccagctgaatttcacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465303 - DNA, 1880 bp, Homo sapiens
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcgtcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctaccctccctcttccactctttcccattcactgactgcagggatgggtgccctgtccttccctggggctcatgtcttggggcctgattcccctgtctcaaggaaagggcagaaacagcaccgtgaggttcgtcaccaccccaaatactt

SEQ ID NO: 465304 - DNA, 5291 bp, Homo sapiens
  misc_feature (5290)..(5290): n is a, c, g, or t
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcgtcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagaaaaaaaaaaaaaaaaaaaaaaaaaaaaaaaaaaaaaaaaaaaaaaaaaaaaaaagaggggggggagcgcgaaaacgagttcccctggggggcgccaagtctaacggcgaaccccggttttagggcacaaggggggcccaataaggggcgcgctaataacaagacaagcacaggggcccgcacataaacaagcgaggagacggggaaaacagggcaccagaggaaactttggataaagaccactacacacggaggtggtgaccacattattggggaaaaaactttcataaaggaagaattatgaggcccctatgagagggtaatcatttcgacaacatcttcgagaagggtgtaataacgggtagttcaaacaacgagagcgaatactatgcgctatgacatgtacagaaaaagactttgtcgcaagatcgaggaaagtacgatatattacgaaacaattatttataaccgggggacataggcgaacaaaacgng

SEQ ID NO: 465305 - DNA, 4711 bp, Homo sapiens
ccggtgttaatcggcacaggcgcgtggtggctgaccacatccgcacactcagtgtctgcatctctgatggcgtcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465306 - DNA, 3472 bp, Homo sapiens
tgggagatgcacgctggcttctcccttctctactgtcatgccccgactttctgttcactccttcctcccacaggcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaaaaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcgcgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacatgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465307 - DNA, 2072 bp, Homo sapiens
ctatctagcaggatctctcgaggtgccttagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcaaagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcactgctgagggcttgaagggacccaatcccgggtgcctggcccctcactgcttgcaaagcagcatcctggccactggggcagtagcctgtttagcagtgctcaccacaggcccaggttcaagctcctctgcgagcgccaagatgagttttggcacccctgatttattgatgagttaacagagcttcgagatgttcatccagggtaaccaactagtagtcctcggcagagctgaagtcaaagctaccctttgaaagccccgccaccctggctgcctctcccttcctgaaggccaatttctttttttttactagccgtccctctggtctgtccctctcgccctccaggagatctggggccccaaccacatcttgtcgcgccagggctggaagagagtttggcacagggcatggactgtgtgaaggagcgctgtgttggcctggaaccttcctgcgtctggtaccagaccttcagctgggggaaaggtggaaggtgccctccctcccgcagggcctaaggtcaacaggaggcctcacgggagttccagtgacttctacaggtgccttggagaaggtgcgtccaccctcctcttcttccacagacgcttttcctggaccagctccctatccattgccacacaaaagctaccaagagagcacaagcactccagaccagcagccctgcccgacccccgcctcccgcagaaagcccacccgttcctagacacgtcccacggaagcacagggcatagcgcaaggccacagtcccactacccgcaaagcggccgc

SEQ ID NO: 465308 - DNA, 1290 bp, Homo sapiens
  misc_feature (2)..(2): n is a, c, g, or t
gntggatatggtttccatgatttttcttccagatatcactacttggaaaattgtggtgtcaatgaacttaaggtcaatcttctccagagcctgccgtttcatctgcaccagcaaggactcgtggagggtgagcacccgcttcttggttcccaccacacagcctttcagcatgacaaggtcattggtcacttcaccatagtggacaaagccacccagaggattggtgctcttgtcagacaggtcagagtcagtggaggcattgttcttgatcagcttgccatccttgataaggtagccctggccaatcttatagatcttcttgttgatctcagtgcggtgacggtagcctttctccccagcacgtgccacagagaaggccacacgagcaggatgccatgccccaatacaggccaccttgcacaggcctcggtgggtcttgcagggcagcttcttggtgtgccaacgactggtgacccctttgtagcctttgcccttggtcaccccaatgacgtcgatcatctcatcctgcccaaacacttggttcacatttacctgctgctcgagcctctcgcagacccagtccagcttctcagccacggtgcctccgttcacctggatctccatcaggtgggccttcttctggcgcagaggaagcaggcgcatctgggtgtgggcaatgacgcggatgacgtggcagtatttcttcatgctgctgaagtccttctccagctgcttcttgacatcctcatcctgccatttcttgcagtacttcgtaaaggccttctttttagatttatgccagttcttatagaaacgcctcttgcattcattactgatgtgctcagcgaagacagtcttgaaggtccggaggcctcaaggggtttccacatagcccacaatgcccacaaccaccatgggtggcgtctccacaatggtcacagcctccaccacctgcttcttgttcaccttggatgctgggctgtcgacttccctcatgatgtgggtcatgccagctttgtatcccaggaaggctgtgaggtggaccggcttggacggatcatccttagggaagctcttcaccttcccacgatgcctgctgctgcgcttctgaggcaggaagccgagggacccatgtctgggagcagaaaactttctccactgcgcctcgcctaataataacttaaaagtacattttaaaaaacttaaatagtgtcattggattgtttataactcaaaggataaatgcttgaggggatggagaccccattctccatgatgtgcttatttccc

SEQ ID NO: 465309 - DNA, 1413 bp, Homo sapiens
gagtcagcccttgcctcgggccacaaccatctcccaagaacagctcagatgaatttgaaatccacaggcttttgtgctagtgaaaaggaaacggaagcgggacacttaaacccttggtcccatgaatgctttcttctgctccatggtctggaagcagccatggccaaacttggaggtggtgtcaatgaacttaaggtcaatcttctccagagcctgccgtttcatctgcaccagcaaggactcgtggagggtgagcacccgcttcttggttcccaccacacagcctttcagcatgacaaggtcattggtcacttcaccatagtggacaaagccacccagaggattggtgctcttgtcagacaggtcagagtcagtggaggcattgttcttgatcagcttgccatccttgataaggtagccctggccaatcttatagatcttcttgttgatctcagtgcggtgacggtagcctttctccccagcacgtgccacagagaaggccacacgagcaggatgccatgccccaatacaggccaccttgcacaggcctcggtgggtcttgcagggcagcttcttggtgtgccaacgactggtgacccctttgtagcctttgcccttggtcaccccaatgacgtcgatcatctcatcctgcccaaacacttggttcacatttacctgctgctcgagcctctcgcagacccagtccagcttctcagccacggtgcctccgttcacctggatctccatcaggtgggccttcttctggcgcagaggaagcaggcgcatctgggtgtgggcaatgacgcggatgacgtggcagtatttcttcatgctgctgaagtccttctccagctgcttcttgacatcctcatcctgccatttcttgcagtacttcgtaaaggccttctttttagatttatgccagttcttatagaaacgcctcttgcattcattactgatgtgctcagcgaagacagtcttgaaggtccggaggcctcaaggggtttccacatagcccacaatgcccacaaccaccatgggtggcgtctccacaatggtcacagcctccaccacctgcttcttgttcaccttggatgctgggctgtcgacttccctcatgatgtgggtcatgccagctttgtatcccaggaaggctgtgaggtggaccggcttggacggatcatccttagggaagctcttcaccttcccacgatgcctgctgctgcgcttctgaggcaggaagccgagggacccatgtctgggagcagaaaactttctccactgcgcctcgcctaataataacttaaaagtacattttaaaaaacttaaatagtgtcattggattgtttataactcaaaggataaatgcttgaggggatggagaccccattctccatgatgtgcttatttccc

SEQ ID NO: 465310 - DNA, 1829 bp, Homo sapiens
acaccaacagaaaatcaggacatcattaattctctacacttattgatttggaacctccattgaagcagcaagctcagcacagaaataaaactgtcctggtgagtcgctcacagcctgtcccagtaactgttccggagcgtcagcctgacgcagcacccctgaaggaccacgccgtgcgggctgcgagcctcgcccttaaccatgcccagcaggaccagagctgccagcacaaatgaaggtcctggccattgaacaacttctgagcctgcactttaagaaggcgctcttgttttgaatacgtagtctgtcctgttctttcaaagtaagtgcttttatcaagggcctggactgtcttttaaacatatttttttctcacttgtacattaaagggaaatgtatttctgtctagaaaaggagaccgggagaggaatgagactgtgcggtattcaggcttggtttaaactagggcatgcacactgcatagctattttcttcaggcagcatgtggccaaaaaacatgcgtgtgtagctgactgttttgagctttgtttattttaagtactgtatactgagggattttgttcaagcaaaggagtaccagctttatatgcagccacagatgcctctcttgcttggtagtgctagatttagagctcaaaattttccttttcagcaagaactagaagttccctagtagtattttttcccctcatgcctgtttgcactgtgcagaattcttagagaacacggctttgcaaatgttctgcggcagtctcaggatagcacggtatgtcagcagatatgggtcccgggcctgtttgcttagctatgctttcttaatgcaggttcttgctttacacgatttcagacaataactcagtattttcatgatcacagctgaatatacgccacggatggataggctctcacctgggggtgattttgtcccccgcggacatttggcaatgtctggagacatgtttcattgtcatgacttggacatgctactggacctagtgggcagaggccggggatgcagctgcacatcccactgtgccctggacagcctcacagcaaagctgtatctgccccaaaatgaagacagtttcaatataggagtgaaggaagctggagaggatgattggagtgctggaggaaataaacgaattgaaaggcaagaccatccatctgggaataccccaccacagagcctacagaataaccaggaagtagaaaactggggcattcctagagcctttttaactgttgtcaaaaaagctagaaaccctgcaatgcatgggacaaccgccataacaaagaattatctggctcaaaatgtaaaacaaggttgagaagccgtgctttaacttaatatttctcagcctctatatcttcatctctgaaataggaatgtccacattagcattgttgtaagccctgttactagaatatagtaagtgctcaataattgttggatttttttcacttacattcttttgaaattctgtgtgttatctgttgcttaataataaaccataacaaatcagccctaaaatttagtgactcaaaacagcaatcatttaatagtctctcgtggtttctgccggtcagtcattcagcagcagcttggctggcaggtttagacttcggatctcttagaaggttgtaagtcagatgtcagctggggctgctgtcatctgatgggttgactagggcaggaggacccacttccaatgtgtctcactagtgtggctggcaaactagggaaactgtcagatggaggtatcagctagcaactcgggctctccacaggactgcatgtgcatcct

SEQ ID NO: 465311 - DNA, 533 bp, Homo sapiens
acaccaacagaaaatcaggacatcattaattctctacacttattgatttggaacctccattgaagcagcaagctcagcacagaaataaaactgtcctggtgagtcgctcacagcctgtcccagtaactgttccggagcgtcagcctgacgcagcacccctgaaggaccacgccgtgcgggctgcgagcctcgcccttaaccatgcccagcaggaccagagctgccagcacaaatgaaggtcctggccattgaacaacttctgagcctgcactttaagaaggcgctcttgttttgaatacgtagtctgtcctgttctttcaaagtagatcctggtcaagaatgtctccaaaactggattaagccagtgtacttgaatgggaatatagacaaccaggacagacttggaatgttttttaatgtattggcccagcaaagctagaaatcctccactttacctaacagaagataattagaattaaaaatggcactaactgaaaacgtacttgttaaattgcctgtgcttatagagttgt

SEQ ID NO: 465312 - DNA, 1803 bp, Homo sapiens
gaatacacaagaaaatgcctattaaaatattggcattctagcctttgaaacagatgtgcttcagttctcactggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccagtgagtacacccaggcccacagctacctgacctggacgtatccactacctgacctggacgtatccagtgagtacactcagctccatggctacctggatgtaaccactgggtacacccaggctcacagctacctgacctggacgtatccactacctgacctggacgtatccagtgagtacactcagccccatggctacctggatgtaaccagtgggtacacccaggctcacagctacctgatctggacgtatccactacctgacctggacgtatccagtgagtacattcagccccatggctacctggatgtaaccagtgggtacacccaggctcacagctacctgacctggacgtatccactacctgacctggacgtatccagtgagcacacccaggccgacggctacccagatgtatccagtgggtacacccacgcccacggctacccggatgtatccagtgggtacaccttggcccacagctacctggatgtatccagtggcacacctgaagcctttgtgggtcctgtggggaaactgctgaggcccacaagcagcacagacggctgtcactccccggccctagtaccctcctcttctcagggacagagggtctgcagggaggagaaaggcagtgaaggacgagatgactccagccagccaggggtgctgcagaaaaggggagcagatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgatgtgagtactgagacgtttggtgttagccagtccgcggttttctccgttactgtgcccctgttagtgactgccacttcacaagtgtcacgcccggcttgtgtcccaagtcagcggtcagaggccagcgcatcatgctgcataactacatatatggacaaggtttttttgtggtttctttcaacttcggaattgagaagtttcgtttttggtgtagatggtgtgatcattggtttttatttcagttgatcctttttgtcatatttttcccgtggacaccttatcctgataggccctgtttaccactctgc

SEQ ID NO: 465313 - DNA, 2040 bp, Homo sapiens
gctcacccactccctcccatctcccccagctcaacccccagcacagcagcatccaccatgtccgtctgctccagcgacctgagctacagcagccgcgtctgccttcctggttcctgtgactcttgctccgactcctggcaggtggacgactgcccagagagctgctgcgagcccccctgctgcgcccccagctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgcccgtctgctgtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagcccctgctgccaggcggtctgtgagcccagcccctgccaatcaggctgcatcagctcctgcacgccctcgtgctgccagcagtctagctgccagccggcttgctgcacctcctcctcctgccagcaggcctgctgcgtgcccgtctgctgcaagactgtctgctgcaagcctgtgtgctctgaggattcctcttcatgctgccagcagtctagctgccagccggcttgctgcacctcctctccctgccagcaggcttgctgtgtgcctgtctgctgcaagcctgtgtgctgcaagcctgtctgctctgtgcccatctgctctggggcttcctctctgtgctgccagcagtctagctgccagccagcttgctgcacctcctcccaaagccagcagggctgctgcgtgcccgtctgctgcaagcctgtgagctgtgtgcctgtttgctctggggcttcctcttcatgctgccagcaatctagctgccagccagcttgctgcaccacctcctgctgcagaccctcctcctccgtgtccctcctctgccgccccgtgtgcaggcccgcctgctgcgtgcccgtcccttcctgctgtgctcccacctcctcctgccaacccagctgctgccgcccagcctcctgcgtgtccctcctctgacgccccgtgtgctcccgcccagcctgctgaggcctccgctcaggtcagaagcccagctgctgatggacacgccccccagtgccagccaggctcaggtcccacctgaaagctgatagtcgcgtcctgaattgctcctgcactttgaccatttcctggtgtctgctgttgagctggacaatggaagaactgaaagtctatactcaatgctgcagccctcttgcggggggaggggggcgcttctagaaagttcccatggcagtggcctcccctccatatctcccacctctcatgagggtcagttcagccttgacccgtgaggtctctgtcctcctggctcagagccgcagagccttctttggacgccctcaagctgaccaataaaggccctgagactgcaatggcgctgacacccaggtgtgttgattaatgccttggctggagctcacggccatggttttctcctttgtgcacaaccctctgctgtccttcaggcccctgagtgttttcctgtgcccaggggcgtgtggttcccaggggtccaggctagacggacatggacgcggggagccttgcagccctttggccatttcgggcccttgggtttgtccctaaccctcctgtgttgttagtcgtgtcatagttctttttgctgatttgctttttaaattatccttctgctgcacaatacttgtcaaataagaatggtgtcttctagcgccatgcttgcccagagtgtgtccaaatgcctccctagcttcaaaatcagtagtcttcatc

SEQ ID NO: 465314 - DNA, 1445 bp, Homo sapiens
ctcaatgactacaagatgcctgcagtcataggttatttcaaagaagataatactgcaaagcgcttggaatatgcatatgtttacatgcttcaaatgatgcggaatcagaaagcagcgattgaaacttactaacccgacctgctagtctttgaactgaagctctttgctgccctctgtagatacctagagatgaaaacggcaaagtcaacattcactttctcagttatggtaattttgttctgtaatcttaatagaaaaatagactaaacagaaggtgtttcaattaaagggaaattaaggatcgttttttcctataatttcttttgtactatatcgttgaatttctgtatttgcctttaaaaaaatcactatttaaaattaaaacttcgtgtttaaaaacactatggtaagacaaagtgaaaatacacacatgaatgcatgaaaaaagaattagtaatttttcaactttcttttgacttttttatcattttatgtatattatccacattttaaaagtcatatgaattatggtagataatgtcctctaaacataagctacaagttctattttcacatgatagttttccttgcctttggcatgataattattgttgtttctagtttcttgggaggggctattcttttgcaagaaaataatcactatttcaattgttgcaattcaacttaaaattattttgctgagcattttctatgcactcagcaaaagtctacatgctgtgtaggggatatcaaaatgatgataataatagcagcaaactgctaagtgcttaaccttggaaagatattgtagcacattactttacatatgctaaccatttagtcttcccaaatattataaggtgtctgattttgtagagcctacaattttgttgaaaatagtattactcgatgttccatcatcatttctctgttaccacaaattgctatcttaaggcataagaaaggtcagccacgttttgtaatgcttgctatttcacagcgtgtatgcggttttactcctattcaggttatcagtacttcaagcttatctatagcatcttgtcttttaagcactgtgttaagactacttctcaagatataatcaactactgaatgtagtttctctaaatattagccaggcttccatctatcatatcttcaaagtagtggttatatctttatgaaaataagatcctaaaagtcctacactgtggtccttcattatttctactaaataaatttctactaattctctctttcttgtcgctgtacttcccttattttgtactggctacaagaagacttacttggttcatctttatgggatgaaattatacttaattagatgtaataataagaaaatcattattagtgaaaacagcagatacgttctagcactgatggtatggaattacagtctgtgaaaaagttagctataacagaat

SEQ ID NO: 465315 - DNA, 2221 bp, Homo sapiens
gataaacaaacatcagcaatggggaatgctcatgggttgtgtggtaacaagaaatccaaacaccaaaccctccaggggctttgggtttgtcacaaatgccactgtagaggaggtggatgcagccctgaattaaaagccacgaaaggtggagggaagagttgtggaagcaaagagggccaactcaagagaagattctcaaaaccaggtacccacccaactgtgaaaaagatatttgtaggcgccattaaagaacacacagaagaacattacctaagagactatttggaacagtgtgggaaaatcaaactgattaaaatcattactgacagaggcagtgaaacagactctgtggaggtgcatgttctcttgccccagggaatggagcaggagggacaggagaatggagcagggagaatgcaaagcatgagggtggcagcagctctgggtgggtcaggtgccaggccctgggtgcagatcacctccttgtcctccggccaggactgcttttactaccatgaagactttaaagcagcatttaacatttgtatcaacacagaagatggagaagacatagtctcactggcagcgcaaaaccttgtcctgtgcatggtcacacgctcagccaccagggcaggctcagctggctttcaatatgtgtgaatgccttgctgagaagctctagccaatggaaaaaggcaagaaatataatatgcacaaccatcagaaaagcagagagtaaaattgggaattaagtgtctcagtttacttatatgtaaaatgtgatattaatggtatctatatttcagggttatttcaaagaagataatactgcaaagcgcttggaatatgcatatgtttacatgcttcaaatgatgcggaatcagaaagcagcgattgaaacttactaacccgacctgctagtctttgaactgaagctctttgctgccctctgtagatacctagagatgaaaacggcaaagtcaacattcactttctcagttatggtaattttgttctgtaatcttaatagaaaaatagactaaacagaaggtgtttcaattaaagggaaattaaggatcgttttttcctataatttcttttgtactatatcgttgaatttctgtatttgcctttaaaaaaatcactatttaaaattaaaacttcgtgtttaaaaacactatggtaagacaaagtgaaaatacacacatgaatgcatgaaaaaagaattagtaatttttcaactttcttttgacttttttatcattttatgtatattatccacattttaaaagtcatatgaattatggtagataatgtcctctaaacataagctacaagttctattttcacatgatagttttccttgcctttggcatgataattattgttgtttctagtttcttgggaggggctattcttttgcaagaaaataatcactatttcaattgttgcaattcaacttaaaattattttgctgagcattttctatgcactcagcaaaagtctacatgctgtgtaggggatatcaaaatgatgataataatagcagcaaactgctaagtgcttaaccttggaaagatattgtagcacattactttacatatgctaaccatttagtcttcccaaatattataaggtgtctgattttgtagagcctacaattttgttgaaaatagtattactcgatgttccatcatcatttctctgttaccacaaattgctatcttaaggcataagaaaggtcagccacgttttgtaatgcttgctatttcacagcgtgtatgcggttttactcctattcaggttatcagtacttcaagcttatctatagcatcttgtcttttaagcactgtgttaagactacttctcaagatataatcaactactgaatgtagtttctctaaatattagccaggcttccatctatcatatcttcaaagtagtggttatatctttatgaaaataagatcctaaaagtcctacactgtggtccttcattatttctactaaataaatttctactaattctctctttcttgtcgctgtacttcccttattttgtactggctacaagaagacttacttggttcatctttatgggatgaaattatacttaattagatgtaataataagaaaatcattattagtgaaaacagcagatacgttctagcactgatggtatggaattacagtctgtgaaaaagttagctataacagaat

SEQ ID NO: 465316 - DNA, 1705 bp, Homo sapiens
gcgccagcccggcggcggccggctgtgggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggtaaagccattcttggacttgaagcttcatggcatcttagtagaggctgctgtacaagttactccaagtgtaactaacagtagaatctgttacaaacaggctttttattattcatataaaatttatgcaggaaataatatgcattctcttttatgaagttaaaatagaaaattggatttctttgtttctttgattactaattagtgaaaataatatgtaaaggtttacaaattacaaataaaccatctgtggtcaagaaataagtcccagatttgtttaaaagttctgcattttatctagtactctgggccacaaaatcaaaatgtatttgctctaacgtagaatgcagatccaatctcaatgttggctgaaatttttgagcttgattagatacaaagcagcttgctcgaagatttaagcgtagacgtttctgtttttaattacagagagaccacccttttcaaacttcaggtgtgccatagtcattttaattaatttgctttatttgtaccttctaacaggtttggc

SEQ ID NO: 465317 - DNA, 1744 bp, Homo sapiens
tcctctaccgacatgtaggttggacaggatgcggtggtgggaggcagtggtgatgttcaccagattaggagctacccccaaaaacaacatattcacgaaagccagcaacagggagctcctgtttgaggcactgttcccagtccggctctatgcagattcactggaccatgcagaaaagggagttccagagccttgccccaagtacaactccaccgtccagtgcgccaagatcctgcgctctcccctttcccacacagcacataagcaccctgtacacatgagagaggtacaagctcctcccgtgggaggaaagcagtattctgaagatgatggctgccaaggggggctcacgtgtcagtcaggtcctccaactgtacaaagacacaaagacactgtcagaagcaaaatgacaggatctagaagctcttgctgctcttgccacctcgaatatgtcacctgtctgcatggagcctcgctcatcggtctgacaacggcatgcgcccggcagccaggcggcactgaaggctggcttactgttccccgggttcacaaaatcaatacagactgactttacttgaattgtgcctcttccttatatgtcctcctcctgactgtgtgtgctacgagtgtagcacattcagatctgctgttacaaccttctttccaagttcagataatcctccttccaccacgccactataaccaccggctccaaccctcctcatgtcagctcccatgagcaaacttcaggctttttacaagtgggctgcaaaacagcatctagccattgtcctcttcaatgtacttaataagtaacttatttattaataaaatacccacatttattactttatataaatataaatgtatatattcaaataagtacgataaatattgaaacagcatgaataatatataattattaataaactatcaataagcagaatttggaagagcaaatacttttgactcattcattcaatgaaaatgtattaagcacttactatgagctgtcagtgttgaagagagaagaggaatatgatgagacatgattatgatcctagcagaactcaggaggaaagacataaagagccataatgcaatgtagtaaaagctctaataaaggcatcactaagtcctctgaagcagcaaaggaaggaaggacaactctcaatgacagaatatgaatctccaaagtttaacaagctgaaatgatgggttaaaagaaaaaaacaaaattggagctgcaatagcaccacgtgtaaggtcccacaattgaaacctgaaggactgtaaaaagcctgctgctgctaagtcttgcctctcctttcttttatttgaaaatagttggtatttggattcactttgcagtaacctgaaattcgtcaaaggcaacaccaatccaagtgttggctgtctcaataaaaatctgtcactgggaaaatggggatgacaggggctgtgcatgagttggagcacattcaaaggatgatgaacaaactcacagccatgcttccttggtagtggatgaggggaggggagccaggagggccgggaatactgctgttgtccaacatttgaagggctgtcttttgtaagaggaagtagacttgtattacatggccccaaggggaacaactacatggggaacagacttcagcctaacgtaaggaagacttttttttttttttttttttttaacaattagagctgcccaaagacagaacggtgctccttgaaaggc

SEQ ID NO: 465318 - DNA, 1158 bp, Homo sapiens
tctttgaaggagccttgaatggggtccaacaaatggtcccctcgccctcatccaggagagtgtccaaagtggagatgtccttacctcagtaccaaacagagggtgatctcacacctggatactttgctaatttgcccccgaaagtcatttcttattggggccgaagtaacactcagcagttgcgagatttgataaggagctctccagataggctcgtcagtcagtcctatgcagagagacccaaggctccacttgagaactgtgctttctcttctgaaaagccattcatccttccttctcttccctctgagtggattactgggtgggtggggaagggggttgccctcctagaacacagaagtaagggtccagaacttaacactgttcaggagcaaactttcccccaccagccatgggggaaagcatcaaatgctgagctcttattagacccaatcagatggaattttcagcaggttctttcttcacactttttaggagggtaaaaagtagtttaatcttccagtgagtcaatgttcctgttgacagagacatatttaagtaaagggtcattattttagggggactcctaacccttcactctatcctaaaaattccctattatcatcctacaggtcaacctaaattttctgtccttagcattttgtttattgggaagcccaccgtctcccatgcttctttgttctgtcttcacagggttgggggatccagctatctgtaattgtgaagtgaagaggatgtgactgccaggtaatgctaaccccgaatccttggtgcctgtgttatgcaccatatgctgaatttcggttccagctgtgtgctaggctgggtctgatctggcaaagaggaactggctccacagctctgggcagaatccactgctgctcccacacagagaagaccaggggaaccgcagtcccactctgatagtgagagcaaaggaaagtggcaacaatgaaggaataaaacccagctcgtccccctgttcctcatgcccaacccttgccaagacttcaggtaacagaaggaagagaacacatggatgggcacatgctgggcccggaagagctgtgcatgtcccacagaccacgagtgtggagcccatggccgtgtgaagggggtggggtcccagtcctagaa

SEQ ID NO: 465319 - DNA, 2097 bp, Homo sapiens
tggcaaggctgccgttggcaaaagcccagctctgccatgaatctccgttcagttactggtttcacactcatttgtgaggaagctgtggcaagtgttgacaccacagccccaagtttctttttctggcccgcggaagatgagcttcagtcccatggaggtgacaaggttgtcctcctgcatgatggggctctgcggtgcctctgcgcctgggtaacccctcaccgagaaagccacgtctacaggtcccacctgtctgcagtgcatttaaggcgcagcctggaagtgccagggagcactggaggccacccagtcatgggggacaccttcatccgtcacatcgccctgctgggctttgagaagcgcttcgtacccagccagcactatgacaaccgcaaagatggtcctcaccccaatcctctgggcttcctccagtgggtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcatggcaggccggggcggggcatgtctgcgtgttctgtctggatggtgtggtgaaggtgacatttccaaatctgagcattggacatcagtgtgtctgtgtccctgtgtcctcaccatccctgatggctgcagggagccgctgggccctgcccctcagtcacattcccgcacctctggcacagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgcgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtggaccgaggctctgcaggaatgcagggagggccgggctccgccccagggttatttctaagttgaggacaggaggttgtgagttctgctggggggaag

SEQ ID NO: 465320 - DNA, 1803 bp, Homo sapiens
ctcttactctgcagatgaagctccagttacacatgatggtggtgtttttggtggtggtggccctggcagtaccggcggtgttggtggtggtggtggtacttgtgatgttactgtttgtggtattgttgtttgtattgctgctggtggccctggcagtactggtgttggtgttggtggtggccctggcagtactggtggtgttgatgctggtggcccttgcagtaccagcagtgttggtgtcggtagtggtatttgtgatgttagcgtctgtggtattgttgtttgtattgctaggggtggccctggcagtattggtggtgttgatgggggtggccctggcagtattggtggtgttgatggtggtggtggtatttgtgatgttagtgtttgtggtagtgttgtttgtattgtgggtggtggtcctggtgatgtttatgtggttgctgttgatggtggtagtggtggcactggtggtggtggtgatggtggtgacgtgtggctccacaggacccactgaaaggcaaggatcagcctggctgcaaactgagttagcatctgactcagttgcttgctcctggcctggagcttctggggtttctgatcccttcactgcaatccatgaatctctcccagcaggtatgacagcctgacccaggggctctgggaaagaggggttttcatcctacatgagaaagaaccacaccaccctccaagggaaaaagcagtcactggcaggcctcaaggtgcgattcgcagtctcctgggtttctggggccatttgtcctggtcctgctcggctctctgcccatccctgctgtgtaaacagcactctctctcagaaggtcttagctttgcttccctaaacaccctggacctgtgatcaggactgccaccttctgccctgaaggtaaaagtgatccagccagggggaggaggggcctgaggagccaggtgcaggaggtcaggggtcaggggttaggacagtggtaccggccaggaggtgcctccgggccagctgggctccatcacacaggcactgccccctcccccagccctgccccagagttgagggaagggaagacaggggaactagaaagaaagcacgaggaccagccagctgggagaggccaggtctgtggagcacctgctctgtgcgcagcagctgctgcctcaggtggagtctgtggttcccatggttcctagagtgaggactcatcctgccagatggagggctctgggttctgctgagcaccttcaggagttcagttgtggtgttggctgtaagtgacaaggaccttgatctggctgaaggaaagagtgttggctcctgagactggaaagctgaggggtcacccacatggtccaagatggctgctggagatccagccattacacaaaactccagtcagcaagaaggaagaagcaacaaagaaggacatcacccccctcccctttaaggacactttctagaaattataagagcacatgtttatgccccttttgacagaactcagtcacatacatgatctgggtgcaagaaaaaatgcaaaatgtgattttttttttttttttggagacagagtcttgctctgttgcccaggctggaatgcagtggcacgatctcggctcactgcaacatccacctcctgggttcaagcgattcacctttctcagcctcccaagtagttgggattataggcgcttgccaccatgccaggctaatttttgtatttttagtagagacggggtttcgccatgttggccaggctggcctcgaactcctgatctcaggtgatccaccca

SEQ ID NO: 465321 - DNA, 3588 bp, Homo sapiens
ctcttgccccgttccccctccgcctctccctcctgacctacccgagtgctttcctgagtggctccacgtggcctcctgtttctagggatgggcacttctccttgctgccaccatgtgaagaaggacatgtttgcatcccttcctgccatgattcctcaactggctcactgccttctttatcccagcctccattgcagtgaggttgggggccatatgactagtgctgcccaatggactgtgaacagaaatgacagcatcactcgcatggagactcctccatctctgtcttccctgttgtgacagtctcagagcctacgttctttcaatggctgggctacaagatggtgacaggctgcccaacctgacacagcaagaaggcggccatctgcaaaccagaaagagagccctcaccaggaaccggatctgctggcaccttgatcttggacttcctatcctttagagctgtgagaaatgtcgcccccaggtcaatgggatatttgttacagcaccaggtactgcctgagaactctacctttagggagcctgcgtgctgggtcactggggagacaatgaaggtgcttgacacccagtttgaatattgtgtcactgcaaagctgactgctgttgaaggatagccagtgagaggtcatggcaagccatcagaagaagcagaagtcatgagcatgctgaagctatgaggccaagacaaaatgtcacattgccacaagaagagggacaaacaggcaacaggcagagcccatgggaatcagtaatctcctgctgacactgaggccttgggactaactcagatccagtactactctcttgggacctgttctgactccagctcctgtccttggggtccactgagatccctgtagccttgtaataagcccacattatcatatttcccctgccggctccaccctagagcatttccaacaatttccagtgcttttccccttctcataccactgggcctttgcacgtgctcgtgcctccccaacttgccctgccttctccttcacccagacaactcctactaaatctctcagactcctcagctgtgtcccttcctaggggaggactctcttccctccagtgagcccggtggtcctccctgggatcccctgctccttgtcttccctgccgtccttactgccatccttgttctctactcagaaggaggcagaggctggcctgcccccaatcccctgtagactgaccagatgaattgacctgggctgggcagggcaggcgtgtttgaccagttgtctgggcaccccatggctcagtccaagttgacacataaagttcaccgccccagggcccctttgttgtatttgtgtatgaataaaacacagcatccactccaggtatctgagggtccctggaggcaggttttgtgatccctttttacagatgaggatgcggaggtccagttgtcactcacccagatcacactctcatctgctgatgggaggagtatttgatgggatgtgtgagcccggccgtctcccttgggacacatcagctcattaaatttgccagcccctgcctgaaaaagtatttaatttgccttttacaatgcacccattgcaagttaattaactggcaattgaaagttataggtggcattagaatttattaataacattgggaataaatctccctggaattcaattaactgaaaacctcatgaaattctttttttatataatccataaagccggtctgggagagagtggggagagcacctttattgtcacatataataataacgctacaggctggtggtcccgcccgcctctgaccacccctccatgaagacagagactgcctctccagacctgcctcaagggccagaagaagatcccagggcccagagggaccaggccacagccaaacaggagtaccaagagcactggagacaggatgggatggacccagagagagcgggtgggctcagcaagactgggaggcagtggccagggatgcctatctggtttggtggacacttgcacccccaatgcttctctctcaaggtcctcaagtccgtatggctggcagtgatttattcagggtctccctggcctctgagagctgcagtccaggctgctcccccagccagtggggaagggggatgaggaagggaagccccaggccctgcaggaccctgcctaccccctcaggctggctggcccagcctccccgcagccctgcctgccttaaggagccgttctggccctgcgccctccctgtctgagttttctctcgaagaggggaagctggcagggtcgagagaacatggcttcaggaactgagggtcctgggttcaaatcctgcccctgccacccgtgatctggtggccaagagagggttatttctaccgtctgagcctcggtccccttgtgaagtggggataataagcttacctcctaagggttaaataatgagacaacgtaacgaaagttccctggacagggccagttacagcagggactcaataaatgatgggtattaggattattctcattcccagcacccagcccacccagaccccgtctccagccgggagtgggggtaggggaggggacaggccagaggagggctctgatgagggtgttggcccctccagaccctgcccctggagacattatctgtccccaaagccccccatgtcctcacaatcatccatgcctggagcccagttcccctgggggcatctttaggaaacagcggcggctcaggcctctggggctgggtctctagccaggatagggtgtcctggagcagtgggctctcacttcctgctgctggcctggtccacgctcttctgtccagggtcgggcccaagcagggcagcaaggaccccatcgggttgggcgccacccctcttcatcttgaggttggctctcagggcagcatcctggccagaacctcctctggggaggccaggggatctggaaggagagcaggagggtggactcgaggtagagccttaggaacacttgggggtacatttgatcatgatatgtggccacggagagatgctcttgcccagcgtggagaagcaaggcagcagcaggctttcagccccttatgcattcattcattcatggatccatgcatccatccattcattcactcattcacccatccacctggagactgtctttcctacaagtttgcgactcctctccctgtcccgggaagcccccccaagggccaatcaccccctctgtggcatccccacccagccaccttctcactctcttgcaatcactgctgtactcagctgagttcccatggggctgtgaacttctcagggcaggggccctgtacacccggtggcccagcacccagctcggggctggctgacggcagagaaggggagcaggtggtccggtgtgtggagagaactagtgatactaacagcgatggccagggtcccacgtgtgctgatgtcagcccagacggctcccgggagccccaggcccgtgtccagctgtcccctgacatcgccacccagctgaccatgagccatctcacctggcccctcagaggagctttttaaagatgtaaata

SEQ ID NO: 465322 - DNA, 1690 bp, Homo sapiens
ctcttgccccgttccccctccgcctctccctcctgacctacccgagtgctttcctgagtggctccacgtggcctcctgtttctagggatgggcacttctccttgctgccaccatgtgaagaaggacatgtttgcatcccttcctgccatgattcctcaactggctcactgccttctttatcccagcctccattgcagtgaggttgggggccatatgactagtgctgcccaatggactgtgaacagaaatgacagcatcactcgcatggagactcctccatctctgtcttccctgttgtgacagtctcagagcctacgttctttcaatggctgggctacaagatggtgacaggctgcccaacctgacacagcaagaaggcggccatctgcaaaccagaaagagagccctcaccaggaaccggatctgctggcaccttgatcttggacttcctatcctttagagctgtgagaaatgtcgcccccaggtcaatgggatatttgttacagcaccaggtactgcctgagaactctacctttagggagcctgcgtgctgggtcactggggagacaatgaaggtgcttgacacccagtttgaatattgtgtcactgcaaagctgactgctgttgaaggatagccagtgagaggtcatggcaagccatcagaagaagcagaagtcatgagcatgctgaagctatgaggccaagacaaaatgtcacattgccacaagaagagggacaaacaggcaacaggcagagcccatgggaatcagtaatctcctgctgacactgaggccttgggactaactcagatccagtactactctcttgggacctgttctgactccagctcctgtccttggggtccactgagatccctgtagccttgtaataagcccacattatcatatttcccctgccggctccaccctagagcatttccaacaatttccagtgcttttccccttctcataccactgggcctttgcacgtgctcgtgcctccccaacttgccctgccttctccttcacccagacaactcctactaaatctctcagactcctcagctgtgtcccttcctaggggaggactctcttccctccagtgagcccggtggtcctccctgggatcccctgctccttgtcttccctgccgtccttactgccatccttgttctctactcagaaggaggcagaggctggcctgcccccaatcccctgtagactgaccagatgaattgacctgggctgggcagggcaggcgtgtttgaccagttgtctgggcaccccatggctcagtccaagttgacacataaagttcaccgccccagggcccctttgttgtatttgtgtatgaataaaacacagcatccactccaggtatctgagggtccctggaggcaggttttgtgatccctttttacagatgaggatgcggaggtccagttgtcactcacccagatcacactctcatctgctgatgggaggagtatttgatgggatgtgtgagcccggccgtctcccttgggacacatcagctcattaaatttgccagcccctgcctgaaaaagtatttaatttgccttttacaatgcacccattgcaagttaattaactggcaattgaaagttataggtggcattagaatttattaataacattgggaataaatctccctggaattcaattaactg

SEQ ID NO: 465323 - DNA, 1064 bp, Homo sapiens
ctcttgccccgttccccctccgcctctccctcctgacctacccgagtgctttcctgagtggctccacgtggcctcctgtttctagggatgggcacttctccttgctgccaccatgtgaagaaggacatgtttgcatcccttcctgccatgattcctcaactggctcactgccttctttatcccagcctccattgcagtgaggttgggggccatatgactagtgctgcccaatggactgtgaacagaaatgacagcatcactcgcatggagactcctccatctctgtcttccctgttgtgacagtctcagagcctacgttctttcaatggctgggctacaagatggtgacaggctgcccaacctggtttgcaacgccacctcagtaagctgagacatggtaatcgccatggcaacggggctgcattaaaagcattgtgcgcacaaagtgaaaggctgctgcctggcagagttcagtctggtctcactgcacctgttccctaattaagatgcaccttttggttttgtcttttgaaaaaaacaaaatgctccctttatcgccacgaggcaaaagaaaaattaaggccaagatcctttcatgcccaatatgggcctgcccggtggttggagcatgggggatcatgggcagcaagtgagaaagtgcacagtgatttgctgctgttacatcctgagaaactggagggctgtcatcaaagtcctcgaatagctggagagtgggtgtgggatggttacgtttgaaaatgcagctctgatataaaagaaagcaaagactgcactgttttcccagcaagagcctagctggagactctaagcctaagatagaagcttctgccatcaacaggccacaaaacccatacttcctgctctatgaggcttctgaccttggttccctagaatcctccctccttatcaagtatctgtgtctaggcctaggggagaccagaccgaggtctgtccttgtctgcctacaaggacaaggcattctactgctgtagaccacttgtttatgtgcccctaaaatttgtatgttaaagcctgaatcccca

SEQ ID NO: 465324 - DNA, 687 bp, Homo sapiens
tggagctaattacagctcccgcccataatgctatcgggaagacgaagcaagttcctgcccgtggagaccttggcactaccccagacactggaggaggatcttccatggactgttggaatctaccgtaaattcagctccttcccctctgatccattcacacctagataccggaggaggatcttctgcggattgttggaatctaccagacagtcacaaatgttccgtagtcactggggcttccctttacgatgccgatgtggtgaatgcgtgtggtgtcgtgtcagtgtgatgcacctgtgtgacctcttgcctctcttgtcttctcaacaagactcggtgacatttgctctctccaagtgcacggcagcagaaaatactgtggttcgcaaggcagggaaagtggattaggcttggtcgtttattctcgttctttccttcttcctttgcacatgggtggctgggaagcagcttcgtttctaagggcagggaatgaccacagcagttgtaagagcagcagctgaggctgagccaggccatgagcattccctccgccagccgtgagagcgcctctttatcatggagaaagcagcatcagagaggccagctcagaggacagcgccgattctccggggctcgggcctccctcagctccaagcctgggtgctgctcttcttgtttgtctgtttg

SEQ ID NO: 465325 - DNA, 5581 bp, Homo sapiens
aagaaactttcgccggatctgcaagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagggttctttgccaagattgtaaagtccccccacacgtgaaagcatcaaaacagacatctcacatttttccactggacataatgattgagtgtgttaaaaattctttggtttcctcaagtccattcctgtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaaggtaatatactaactttattttatcttattattagattgcaaacaataatgcttttttttcctgtaggaaaagtcactggagtgtactcatataataaatcatgttgcatgttgacatcaaattttagcccaatcatattactaatactcggccaaactgacgattgccaaagcaattcacatttcttcttcttggctgaaagcatacattttaaaaaaagaaaaaaaatagtgaataatctcctcttcatctggttttcttctggggcatttatccgtgctgatcttggtgaatggggcatgagtctaacgatcagagcccctagtgtagattacagaaacactctgggactttgtggaacctttgatgaaaatccggaaaatgatttccatgacaaaaatgggatgcaaattgatcaaaattttaacaattatgttgcttttattaatgaatggaggaaacaaatgtttatgtacaaaattactattctttcctgttttccatctggaaggattttaccaggaaaaagcatgtctgacacactgccagtttctatgacatcacctggaaagccatcctattgtagctgttcattggacactgcagcgtatccgtcttccgaagatctggacagtgtttctcgatcagaaattgccttgggttgcaaagacctcaatcatgtcagcttatcttctttgataccagaactagatgtcacctccgaatatattaattcagacactcttgtcagagagataaacaagcatacatctccagaagaatataatctaaatttatttctgcaagaaaaaaaacacataaacctgactaaactcggcttaaatgtacaaaaacatcctggaaatgagaaagaagattcactacaatatttggccaataagaaatatacacaaggccggggaagccacagccaagaaatgaggtacaatcgacaaaacagatggaaacggcagaactttcatgagtttcctcctttgtttgctttcccgagtctcagccaaacggatctggaagaacttacttattttttcccagaggaccatgctgaggatgtacagcaagagtttttcccctcttggcccactccctctggcctcaccgagtatagcaccttgaccctctgtcaggagactctagccaactccagcataggaaggctgtgtcttgcttttcttggcaagagattagacagtgttatagagatgtgtgtgaaggatgttctgttaaaagatgatcttagttgggcagaagcaggtgtggcccttttagaaaatgaatgtgaaaagaggattgtggaggaggggaaatataacacagaagagtatggcacatcaattgaagacattctctcagtattaaaatgccccaatttatgcagcggcaatgggcagtgcatggaatgggggtgtgcgtgttccccaagctttagttcctatgactgcagtgattcctatgacaaagctcctgaaattacagagcttgggaatgctggattctgtgatgttcaaaaatataattgtatgatggtgagagtttttggcaaaggcttcaaagaattaccttcaattaaatgtgaagttactaagctacagtataatagcagtgaatggatgcctggagaacccatctatacacagactgttttccacaatagcagagctgttgattgtcagctgcccactgatgttcagcagtttgataccatggatctggtgggtgggaaaccaactgggaagtggcagttgaaggtatctaatgatggttataaattcagtaatcccaaaataacggtcatatatgatggtgcttgccaagtttgtggtctctataaaaatgactcatgtactataaaggaaaatgtttgcattattgatggactctgctatgttgaaggagacaaaaatccaaccagcccttgtttgatttgtagacccaaaatttcaagatttacttggtcatttttagaaaacaaccagcccccagtgattcaagcattgcaagacaaattacagacattttatggtgaaaactttgagtatcagttcgtggccttcgatccagaaggttctgacatccattttacgttggactctggtcctgaaggggcaagtgtttcctctgcagggctttttatgtggaaaacagatttactaactacccaacaaattactgtacgccttaatgatgactgcgatgctgaaactagagtcacgattgaggtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaagttgaaacacagtttgtaaatcaatttactacacaaactgtggttctcacaagatctgataaaagtgtaaataaagaagaggatgataaaaatgcccaagggagaaagaggcatgttaagccaacaagtggaaatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcacatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagattccaaaaaagcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaatatttaataaactgaatattttctcagccctaactgtgactatgtctgcatcattaggagtcagtcagcctaatggaagccacttgatatcatcctaataaatgatgcttaatgcagaacgaggggctcacagaatttgctttgctaaacttttgataagcaatatcaggctggacttttaaagacctcttgaggctagaaagccaagccaatgcatacttgagacttttcctgcagtacctatagattcgttctatgtacattctgaaatatggcatcccagtccaaggcttggaaatatagtcaatattaccaattgtattttattataaaagcatatttttttgaatttatgaacatatattgccataaaataagaatactcatgaatagtttctggattttggagggattagataggaaaaagtaaacgtttcaatttttgatcacaagggtataccttaccaaattgctataagctatagatagcttttttaaaagtttccttaaatctgaaaaacaaaatgttaaaagaaccagcaatatttaaaattttaaaagccataaaaatccgtatctttcctcataattttttcatgttttcaaactgagacatgtttagcttctctgtatcacataaaagcaagatgccaaaagatgtatactttaaacttagattcagcaattaatatttcagtttaatttagaaatgacttgagtatttcatgaatatctattacatatattagcataactttaagatttcaagttattgaaaaagatgtttgccactatgacaactttatttataaacttttatcccatttatattaacctaatttacttgttgttaacaattatgcttgaattgcttcttcaacaaaactagccattgaagtttggaaaatgctatgcaaaatatgtcattttggtagattgatttttgagcatacctcattttatcatactttacagaactttacaaatactgtgttttttacaaattgaaggtttgtggtaaccctgaatcaaacaaatctatcagcaacaatttttccaacagcatatgcttagttcatgtttctgtgtcacattttggtaattcttggaatatttcaaacaattattatat

SEQ ID NO: 465326 - DNA, 723 bp, Homo sapiens
caacaagaaggccctcatcagatgccaaacagatgatggtgccatgctcttgaacatcccagcctccagaattcctcagctgaaaacacagaatggcctctcctggaatacggaggagacacatggtcccggccctgctgcgcctcgcctgctcctcccaagccctggaacaactctcccctgctgcgctctcactggcagggcatggctgttttttcaccatttctgaagacggatccttcactcaacagctgtgtttgtttacagacctagaaatgaacgcaggacacatacgcttgatccaacggaactcccaggataccgtcattgcaaaacggacttcagctggctgcacatctgcgtcgcacggcggcttaaacatcaagccaactattaagatcccctctagcaacatactcctatcccctggagaagaactgcgagaatatggacagaaaatcaatatgttgataagacatattatgggcactggaaaaacacttaaaatgcgtggacacacactcagacatgcacattgagttgcatctttttatttaatcagaatataaggattgttacagatgcaattatgttcagagctagaaagaatatttatttagtaagctggggatgaagcttatatttctatagaatttatgtgccgttttactcagctagcacttaggacatatgtatatatgttatatatttgtatattgtccc

SEQ ID NO: 465327 - DNA, 1503 bp, Homo sapiens
  misc_feature (2)..(2): n is a, c, g, or t
  misc_feature (4)..(5): n is a, c, g, or t
  misc_feature (8)..(12): n is a, c, g, or t
  misc_feature (15)..(16): n is a, c, g, or t
anannatnnnnnacnngcactgggaaaatacactcactccaaatgggagaaattggtcaaaatgaaggggctacaggcctcaagcaagtccaaaatccagtgaggcagtcaaaccataaaggtccaaatgatctcctttatctgcatgtctcacatccagggcatgctgatgcaaaaggtgcacagggcaagctgtcagtgggtctaccattctggggtctggaggacagtgaccctcttctcacagctccactaggcagtgtcccagtggagactctgtgtggggggtccaaccctacctttcccttctgcactgccctagcaaaggtttgccatgagggctccacccctgcagcaaatttctgcctggacatccaggcatttccatacgtcctctcaaatctaggtggaggttcccaaacatcagttctttacttctatgcacccacaggttcaaaaccgcgtggaagctgccaaggcttggagctttgactcagggacctaggatccctccaccttgtgactttaccatctcaacatatgacctccgggatagagtgattatgtgttaacaaaggccaggcattcagcctatgtcccattgcttcccacacagaaagccaatcactgagacaatgagtaatgccagggaaaaaggctttattatgggtgacatcagccaaagagatgaacaccatgaagtcatcttctacttactcacaattggattataaactgtgtgagggcagagcctaagactaactcatgtctgcgttctaagatactggagcagtgtctggctcataaaggacatcaatgggtgtcctaaatacatgtcaattgcttgaattgaatgacagggcagattggctatggggcaggtctcagagtgtgtaggtttattcctagagcatatgggcccggaactttcttcaggaaagaaggtctgggaagtatgtgtgcagtgacatttcttgtgttcctccctaacttgaaaatccccctcttctgacaacagtgaggctctaggaccctgtccttacacttagtggacccaagcatggagcatgtgaccctggccagagccaatcagaatatccctggccagtggttcaggagtgggcacataagctaagtcagcccagcaagaatgaatcttaggacttcttcaaaaattactggaaaagacacttgctctttcctgctgaacttgaatagaaagctggagtcactggagctctcatgccactatagggaccatcggaatgaagccaacacaccaaggaaagccagaatgctgaaagacactagttactgctgaaatagcttgaagcaagtaaccagttttacccttggacttttcctattcctaggtataagtccaactagtagagccacgtctctaggaaggtcagcaagacaggagccttttttattgttattctttagcattaaataaaggctggagattggacatttcaagctccagggtctatgtttgga

SEQ ID NO: 465328 - DNA, 1074 bp, Homo sapiens
gatattgggagtaatgtcgtcctccccaaacctggatgttagcaatgagatcacagagggggtgtacacaccctgcgacattggaagtaatatgatcctctccccaactggatactgggaaagataccacagcgcgggggtgctgtacaattacttcgacattgggagaaacatcatcctctattttcctggatattgggcacaaaaacacaaaagggtgtacaacccctgcgatgtgtccaagacacacagagccacagaatctcacagatgtctgagaattcctcctcctgggactctcagaggatccagaactgcagccggtcctcgctttgctctccctgtccctgtccatgtatctggtcatggtgctgaggaacctgctcagcatcctggctgtcagctctgtctctcccctccacacccccacctgtgctgggctgacatcggtttcaccttggccacggttcccaagatgattgtggacatgcagtcgcatagcagagtcatctctcatgcgggctgtctgacgcagatgtctttcttcatcctttttgcatgtatagaaggcatgctcctgactgtgatggcctatgactgctttgtagccatctgtcgccctctgcactacccagtcatcgtgaatcctcacctctgtgtcttcttcgttttggtgtcctttttccttagcctgttggattcccagctgcacagttgaattgtgttacaattcaccatcatcaagaatgtggaaatctctcattttttctgtgacccctctcaacttctcaaacttgcctgttctgacagcgtcatcaatagcatattcatatatttcgatagtactatgtttggttttcttcccatttcagggatcctatggtcttactataaaatcatcccctccattctaaggatttcatcatcatatgggaagtataaagccttctccacatgtgcctctcacctagcagttgtttgctgattttatgtaacaggcattggcatgtacctgacttcagctgtgtcaccaccccccagcaatggtgtagtggcgtcagtgatgtatgctgc

SEQ ID NO: 465329 - DNA, 2473 bp, Homo sapiens
gacggcttgtgttgagggcaggaaagggtgcacacagctccggcaggtgcttccgcgagaaaggtgactgatacaacaacgtagaggaccctgcaatgtggagaggcatgaaactggaggtccagtgccgtgagttaacaatcaagacgtccatacaggagatgcattggtggatgggtgaagagatgataaaacggataattcagtggtgatcttcagaagaattccacaaaaaaccaaattaacagatgaaacaatctcataagccacttgaaactgaatttctctagaacaagagtctataaaattttttgatcaaacacccactggaaaaattttttagcgtggacacccagtatttgaagttcttggtaaattactgtgagtaaagatttaaccaaccccttgtccttatctatgaacaaacttcactttgtgttaactttaacttgtcatagaaaccttatgaaggcagagtgttcattgtggtataaaacaacattggttgtaggccaggcgcggtggctcacgcctgtaatcccaacactttgggaggccaagacaggtggatcacctgaggtcaggagttcaagaccagcctggcccacatggcaaaaccccatccctactaaaaatacaaaaattagctgggtgtggtggcacatgcatgtaatcccagctacctgggaggctgaggcacaagaatcacttgaactcaggaggtggaggttgcagtgagccgagatcacaccactacactccagcctaggtgacaagagtgaaactccatctccaaataaataaataaaacattgctcatggtaaaaatgacctctgacatgtagactgcctctggcttgaaagtactgaataatcttaaaacacctagtgggaagccatacctttagcctctgttactgtcttaactgaatgtgggaatctaaaagacaaactcagggaactggtttcccgccggtcaaggacttccaagccaagcccccacccataatggtttgctcctgaattgcatttgggccaaagagtagagctcttccatgcctgtaccgcagtgaagtgtgtttcttctcctcagtcctccaaagtggagctgctgccaggcgtggcattatatgagtgtcaggggttaaacctaagaagactacctagtgagcgctgcagtttcatacatatcctactgaaaatcttaaaagcaagctttgcttttttgtaaataaagcgaatatagaagtctttctcgtctcagtaatgatgaactggaaattctgttcccctcctccaacaaaacagattctgtggaaaacattttttgttgtattgctaggttttaggaataatgtttccaaaggatcaagaaggaagcaaaacgctgggcacagtgggaggcagagcacagggaatcagaactccagttataaggggacctacacagaagaaggtgacaacagagatggcatgttggttatgaacagggaaattgatcagatatataaatatatgaagggtgatggagctaagtttcacactgtgcaaatagggagttacttatatgaagaaaaagctaaaattaaccctatgtattacttggaaaaacaactgatttcagaactggggcatggaattcgcaagatcagcctggaacatcttgttccctccaaaaatcaaggaagtgcttgaatagtgataaagatatgtcaaaatgacacagaagtgagatttaatgggccaaagcagagatgagatgagcatcaaattaaataatgagagcaatagactaaaaacaggaaagcttgtgtctatacaaatattgataaataataaattgaactttatatggaaacagtatatcaaaatagttaaggtgttccttcctagaaaatatatattaattacatagtagaaaagaataattttcagtggaaaagcctctaaaaccaccctaactgatcaaagtaaacattttcaataatgggataaataaaagttgccacctgatataatacaataagaagagtacagcatcacttctgtgatcatcctgtcaaagatacctaaccaaatctaattctgaagaaaaaaggacaaactcaaattgagagacattccagaaaataattggcatgtaatcttcaaagatctaattacgaaagtcaaggaaacactaagaaaacatttcagactgaagaagaaaaagacatcacaactaaatgcaataaatgatcttttcactcttattgggacaatttgcaaaaattgatagggtctgaaggttagatggcagtaacacaccaagttaatttcccgatttcagtgattaatacgctgcatgtaggaagaaagcctttgtggtaaatacatactacatacagtgcttgtggctgatggggcatctgctcagcaacttggtcacacatgattcacaaaaaaagtttaattttactcttaaactttctac

SEQ ID NO: 465330 - DNA, 414 bp, Homo sapiens
gacggcttgtgttgagggcaggaaagggtgcacacagctccggcaggtgcttccgcgagaaaggtgactgatacaacaacgtagaggaccctgcaatgtggagaggcatgaaactggaggtccagtgccgtgagttaacaatcaagacgtccatacaggagatgcattggtggatgggtgaagagatgataaaacggataattcagtggtgatcttcagaagaattccacaaaaaaccaaattaacagatgaaacaatctcataagccacttgaaactgaatttctctagaacaagagtctataaaattttttgatcaaacacccactggaaaaattttttagcgtggacacccagtatttgaagttcttggtaaattactgtgagtaaagatttaaccaaccccttgtcctta

SEQ ID NO: 465331 - DNA, 1251 bp, Homo sapiens
gacggcttgtgttgagggcaggaaagggtgcacacagctccggcaggtgcttccgcgagaaaggtgactgatacaacaacgtagaggaccctgcaatgtggagaggcatgaaactggaggtccagtgccgtgagttaacaatcaagacgtccatacaggagatgcattggtggatgggtgaagagatgataaaacggataattcagtggtgatcttcagaagaattccacaaaaaaccaaattaacagatgaaacaatctcataagccacttgaaactgaatttctctagaacaagagtctataaaattttttgatcaaacacccactggaaaaattttttagcgtggacacccagtatttgaagttcttggtaaattactgtgagtaaagatttaaccaaccccttgtccttatctatgaacaaacttcactttgtgttaactttaacttgtcatagaaaccttatgaaggcagagtgttcattgtggtataaaacaacattggttgtaggccaggcgcggtggctcacgcctgtaatcccaacactttgggaggccaagacaggtggatcacctgaggtcaggagttcaagaccagcctggcccacatggcaaaaccccatccctactaaaaatacaaaaattagctgggtgtggtggcacatgcatgtaatcccagctacctgggaggctgaggcacaagaatcacttgaactcaggaggtggaggttgcagtgagccgagatcacaccactacactccagcctaggtgacaagagtgaaactccatctccaaataaataaataaaacattgctcatggtaaaaatgacctctgacatgtagactgcctctggcttgaaagtactgaataatcttaaaacacctagtgggaagccatacctttagcctctgttactgtcttaactgaatgtgggaatctaaaagacaaactcagggaactggtttcccgccggtcaaggacttccaagccaagcccccacccataatggtttgctcctgaattgcatttgggccaaagagtagagctcttccatgcctgtaccgcagtgaagtgtgtttcttctcctcagtcctccaaagtggagctgctgccaggcgtggcattatatgagtgtcaggggttaaacctaagaagactacctagtgagcgctgcagtttcatacatatcctactgaaaatcttaaaagcaagctttgcttttttgtaaataaagcgaatatagaagtc

SEQ ID NO: 465332 - DNA, 977 bp, Homo sapiens
tacagtagccacaaactgggccctgaaagcacatagccagtgtttcaggagtcttctccgtgcccttctaagtgagtatgagagagaacttttatggttcttgaaggcattatggcccccataatctctgaagccagggaaatacttaattccacattcatggcttttgggaattcaagtagaatccagaatgttggacctgatgctccatgaatttgtgggaatcaaatcaaggttgtcagtggttacagagtgccaagaggacttgatatttccatagattttcttcttccaaatgaagcttgaaattatttgtctatagttctgccggaggcctctccagattgtgatgcactgggagcaagccaccatgaacatatcctcaggtctccagtcttctgccatcgcatgaaaaatggagcttgtcaaacacagagcagagctgaactttctgaattccacaggacagttcagagtgcttggaatgacacccacctgcaatttaaacaaaaaagaaggatgagtaagtgaggagctaaaaattgcatgtttccctaaattagatttatttgtaagctttaagtaagtgcaaacatatttcgaattatctgttatgaattgtggttttgttattaaatagacattttgtttaattcttatgtgcaaagtgaaaagagacttgttttgctggatttttctttttgcaagatgcctaactggttacttatgcaagcattgttattgaaattagggggagtaaggggaataaaaaatgtatggaaattatgagtgttagaactgagcacaatcattgcagcatctgatgcagacatttcaggtaatggatcttctttatatactttggttacagggcttctcttattgaaagaacagttacttacaaatttaagtctggactcagcaaaaaataatgctatattggacgacctcagaatattttatagagtgcttatgag

SEQ ID NO: 465333 - DNA, 1221 bp, Homo sapiens
cactgtccagccagtcccagtgagatgaacaaggtctatttgatgctgtactatgctctggccctaaatattctgtctcaattatctgtccagtatgcttccttggatctggtttcaacatacttcggtagctcaatgatctttgttcctatccatattctaaattctatttctgtcatttcagctatttctgcctggttcagaacccctgctagagaggtgatgcagttgtttggagccgcagtggtagggcagctgcagcagagtgctagtgggtgccggggttcctgcctctctgtgggtgttcatcacggtagcagaggtaatacagcttgggggccacttctggtgattgtgtgcgtagttttcctggaggcgatgttggctccagttgggtgtggcactggcaggtgcaggtccgagtgccttctctgtgcctcacaagaaagagtggtcactcaggatggatatttggctaagtattgatcaataagataaagtggaatttgctgggtggtgggcgggggtcctttgtgtaataattttgtgtcttgataaagtaggaatatggctgggaccatccctgactctcttttttccttgaatgtgaacacatgagtgaagcatacatccattgtccatggggcaagaaacatgaggatgaaaagccaatatgttaaggacatgaagtgaaaagcgggaagagcttcttattcatgttatcactgagcagcgggaactgggggctctgctcattatagttgcccacggcctccagtcaatgaaatttccggccaatgaaatgctctactgtgactgaagcagcaaagagaagatgttctgccggaggcctctccagattgtgatgcactgggagcaagccaccatgaacatatcctcaggtctccagtcttctgccatcgcatgaaaaatggagcttgtcaaacacagagcagagctgaactttctgaattccacaggacagttcagagtgcttggaatgacacccacctgcaatttaaacaaaaaagaaggatgatttgctgctacatttgtgtgggaagtgctgcttgccgatagggaagtaggagaggaaataaggaaaacaataaaccaagtacagttttgcaaatacccagacacattggatggacacagaagctttcactgggagattatgaagggtagatgctttgtgtctccattgcctcctgtgatgtg

SEQ ID NO: 465334 - DNA, 1611 bp, Homo sapiens
cactgtccagccagtcccagtgagatgaacaaggtctatttgatgctgtactatgctctggccctaaatattctgtctcaattatctgtccagtatgcttccttggatctggtttcaacatacttcggtagctcaatgatctttgttcctatccatattctaaattctatttctgtcatttcagctatttctgcctggttcagaacccctgctagagaggtgatgcagttgtttggagccgcagtggtagggcagctgcagcagagtgctagtgggtgccggggttcctgcctctctgtgggtgttcatcacggtagcagaggtaatacagcttgggggccacttctggtgattgtgtgcgtagttttcctggaggcgatgttggctccagttgggtgtggcactggcaggtgcaggtccgagtgccttctctgtgcctcacaagaaagagtggtcactcaggatggatatttggctaagtattgatcaataagataaagtggaatttgctgggtggtgggcgggggtcctttgtgtaataattttgtgtcttgataaagtaggaatatggctgggaccatccctgactctcttttttccttgaatgtgaacacatgagtgaagcatacatccattgtccatggggcaagaaacatgaggatgaaaagccaatatgttaaggacatgaagtgaaaagcgggaagagcttcttattcatgttatcactgagcagcgggaactgggggctctgctcattatagttgcccacggcctccagtcaatgaaatttccggccaatgaaatgctctactgtgactgaagcagcaaagagaagatgggtggctttgaaatcagaattggatgcagagggagtcccagaggccaacactgtgaacataagaagggaaagaccagttctgcaagcacagatgtaattttgagaagcagagctacagttctgccggaggcctctccagattgtgatgcactgggagcaagccaccatgaacatatcctcaggtctccagtcttctgccatcgcatgaaaaatggagcttgtcaaacacagagcagagctgaactttctgaattccacaggacagttcagagtgcttggaatgacacccacctgcaatttaaacaaaaaagaaggatgagtaagtgaggagctaaaaattgcatgtttccctaaattagatttatttgtaagctttaagtaagtgcaaacatatttcgaattatctgttatgaattgtggttttgttattaaatagacattttgtttaattcttatgtgcaaagtgaaaagagacttgttttgctggatttttctttttgcaagatgcctaactggttacttatgcaagcattgttattgaaattagggggagtaaggggaataaaaaatgtatggaaattatgagtgttagaactgagcacaatcattgcagcatctgatgcagacatttcaggtaatggatcttctttatatactttggttacagggcttctcttattgaaagaacagttacttacaaatttaagtctggactcagcaaaaaataatgctatattggacgacctcagaatattttatagagtgcttatgag

SEQ ID NO: 465335 - DNA, 856 bp, Homo sapiens
tccttccaggaatgctctcacctgtaaaaatcacctgtagcctctttagtgtctgggacaacaggccggcactggccttgggtcggctgaggatggctgagaacaaaggctcccacctctgcttggagcccttggtggctcgtgaagctcttcacgtggtgcctggtgaccaaccctgggaccccaggcaacttcatgccaaccacaggccacagtgatacatggaaggacgctctagcacctttaggccacgccaatggaaggaggggtcctcccgcacctgcagaccacgctgatggatgaaggggttctcccatacctgcagaccaccctgatggatggaggggtcctcccgcacctgcagaccaccctgatggatggaggggttctcccgcacctgcagaccaccctgatggatggaggggtcctcccgcacctgcagaccacactgatggatggaggggttctccggcacctgcagaccacgctgatgcatggaggcgttctcccgcacctgcagaccacgctgatggatggaggggttctcccgcacctgcagaccacgctgatggatggaggggttctcctgcacctgcagaccatgctgatggatggaggggttctcccccacctgcagaccacgctgatggatggagaggttctcccgcacctgcagaccaccctgatggatggaggggtcctcctccacctgcaggccatgctgatggatggaggggtcctcctgcacctgcaggccatgctctgtgtgtgtgtgtgtgttttaactttgttgtttttgtaaatggacaatgtgtaattgtctatatttacggagtacaaaacaatgatacaatta

SEQ ID NO: 465336 - DNA, 779 bp, Homo sapiens
  misc_feature (2)..(2): n is a, c, g, or t
  misc_feature (4)..(5): n is a, c, g, or t
  misc_feature (9)..(10): n is a, c, g, or t
  misc_feature (12)..(13): n is a, c, g, or t
tncnntgcnncnngaatgctatacgccatgttgtgtccacaaaatgcgtaccccaaaggaaagacactatcttcaaacataaaagtacaagatgaagcaacaagtgctgatggagaagctgcagcaaattgtccagaagatccaggacctcctgtgaataccaaaatccacagatgctcaagtcgctggtatacgatggaaagttgtaacaacatatattgtattccaaccctctatgaaggtgccagactccaacttgtcagtgctcagcgctatgatttaaacccttttagttttgctcttttgccaaaggaagagggatactggaggtgggctctttgcagctgtaaaagtcagaataataaccctccaactgggagaggtaatgaaagaagatgttttctcagtgattggaattgctgctgcccggactggcataagccagttgttcaggaactattggatgctggtgaagatatcatttcaacttacattttctcggcttatgtagtcaatggtttaatctatgctgatgattaaatatctctttattaaaaacatgagttttttgttttgtttttatgtctgtttttccattttagttcctaaagcacagattgctccagcactgccatccctaattcccatatacacttctctgcaaagtgtcttcattgtggtgtcacttgtgtgtatctgtgtcctctgtgctataactgcaatgtgacccgtttcccatgaatgtcctggggtggtgcttgagcttttcatgggcttgc

SEQ ID NO: 465337 - DNA, 676 bp, Homo sapiens
ctttctcatctgcagcacgagggagaggaatgggctgaggcttgccatggtgctttcagggacaggcgtgggagcatctgtgggaaagttttcactgaattcagaagtatttggaactggggctggtcatctggatcccagaaaacactggcaaacacacgcacagaaatgcacagaaaaagaataccccaacattgaacaccaaaggccctcagactttggcgcctccattttgaagcaagtaacagaaaacccagatgactgcagcttacaaagtaaagacatttctctcccattacaagaagcgtggagaaagcatgttgtagaggctcagtgttgtcacagaggacctaggacgcttccaccttcctatgctgccatctcagtgttgggggatgacttccctcatggatgcaagaaggttactgaaacgccaagtataatgtcactacctcatgtggcaccgcgctttacggtaagggggtgagcataaacagaggggattccaagtgctgttctctttgagcaggggacatttttcccagaagcccctggtggttttcttcttgggacctgcttgcttgaacagcatcacctgcctctggcataggggaaagagattgccgttattggcttagaccaatcactaccttccctggcactggacacatgccac

SEQ ID NO: 465338 - DNA, 2482 bp, Homo sapiens
cggtcataaattgccctgtgtgagaaagggggccttgccagaggggaccttgagaaatgaagcgtaagcctggaaagggaattccagacctgggaagagcaggaacaaaagttcaaagggaggagatcgcagtgcgcgtgcagcttgctattgctgcggcgaaaactgtaacacgggaagcactaagagacagaaccgggaagaagcatgacacatggcggtcagccccagaggggacagtcatcctttatgacctccctgccttcagtgaggtcctcaagatgactgagcgcttcagcaccaggattcttaaccaaggagcagaaaacaggctgacacataaccctggtcagagcctgaccctaaacccagatctcagacccttaattctaaccacagactggcccaaccctgcagagattgtccatgaccctgaccacagactgacctaaatgaggctggtctaggagtgcatgcgggaattggaaatagatgtcctgcccatggaggccagagagctgtgtccacaaaaggacagggtgtgaccagccagagttgccggagttttggcaacttgtgtcttccataatagagctggggcattgatggaaatggagggtgctagaaccttgtgactttggccaggcaccaatcatctgcctccttctgtgcctgcctggctgcccctaccctggggctccctcctagcccccacctcacctactggctcactgagacagagccaaacatgaaagggaaggtgacggcctggccatagggcccaggaaaatgcaggtatcattaacagcctggagcactgtggcctgtccactctcaaccctctgctgcccaccccttcctggaatagaccccaggccacatacagagggggcaagcccaaggtatgataccagcagggccaagtggactgtccagatgggtaacgggggcctgccttcctctggcctccacataggggccgcaggtgttcacatggttggaaatgggagggccaatgctgttcataggccgctgtctggtccacaggactcaactggccctccgaacgctatcccactttccagccaggattgaaggagatcccatcttgggtctaaaggaatgggggtgaagactgcatcttgtcgttccagttccaccccattctggcatgggaagcatgtgtgggcttctactctatgggagattcatagcctcaatccttaaggaattctcaatctgaaaggaaaacacaaaccctgacctcagggagctcccagtttgacagtggagacagagaggccctgcatcaagtagaaaaacaacccccactgctctcaagcacacagcaatgaagatatgtatccttggtgctacaggcaaatgctgacgatacgacagtgaatacaacatgaaaaaacaagcacacttctcacccctatggagctttattctggtcaggcagaaggagaaggaaatgtaaacatgcaaggtcaggtactgctgtgaagcaaaataaagctgtgggtactgtgcgaaggataggctgtgtgtgtgtgtgtctgtgtgcgtgtgtgtgtgtgtgttgtgcatattaagtcaaaaaatgaatctggatgatcctgggccaggtctgaccccagcattgccactgactgtataatctcaagcaagtcatgcctcccctctgggcctcactttcctcatctgtaaagtgagaccgtggactgaaaggccattgtgatctggcctcagtcttgaccctccaggatctaacacattttgcctctgtgaatttaatggggggaattataggcagcttagaagcagttctgaaggagaacctctctgctccagcaattccctgaggttccaatttttctgttgatgtcacataatgtgcatagatttgcatactaggcccccaaactcccagggaaggcacgtctcaaaaatgtcaacgattagcacaaatgacttgacttatattcaggcctcttcccagagcaaggggaggaagttgaggtcacctccagctacaaagaaagcagaattctttgccctgaagaggcagagagaggagccctgcttcttctcctctccctggtgccctccagcccattccctcatctctgctcagacacccctggctggactccccaacaaatgcccagggggacctcctaaagacctactccgagtcacttgatgactttgcctaagcccctaacaggagctgcgtgaccctgccctgccctgttagtgtccagagcagcagctttcagggtttacagaagcctgggggatccagagcacctccaactccagtcccgccacctcagcccatgccaggccaatcctagaggctccaacctctaatacctcccaaggtaatgggaatcctaatgcctttcttttctctgcataggcttaaaccagatggcccatgacaagcccttccaattcccgtgtcccagagatg

SEQ ID NO: 465339 - DNA, 2299 bp, Homo sapiens
cggtcataaattgccctgtgtgagaaagggggccttgccagaggggaccttgagaaatgaagcgtaagcctggaaagggaattccagacctgggaagagcaggaacaaaagttcaaagggaggagatcgcagtgcgcgtgcagcttgctattgctgcggcgaaaactgtaacacgggaagcactaagagacagaaccgggaagaagcatgacacatggcggtcagccccagaggggacagtcatcctttatgacctccctgccttcagtgaggtcctcaagatgactgagcgcttcagcaccaggattcttaaccaaggagcagaaaacaggctgacacataaccctggtcagagcctgaccctaaacccagatctcagacccttaattctaaccacagactggcccaaccctgcagagattgtccatgaccctgaccacagactgacctaaatgaggctggtctaggagtgcatgcgggaattggaaatagatgtcctgcccatggaggccagagagctgtgtccacaaaaggacagggtgtgaccagccagagttgccggagttttggcaacttgtgtcttccataatagagctggggcattgatggaaatggagggtgctagaaccttgtgactttggccaggcaccaatcatctgcctccttctgtgcctgcctggctgcccctaccctggggctccctcctagcccccacctcacctactggctcactgagacagagccaaacatgaaagggaaggtgacggcctggccatagggcccaggaaaatgcaggtatcattaacagcctggagcactgtggcctgtccactctcaaccctctgctgcccaccccttcctggaatagaccccaggccacatacagagggggcaagcccaagccaggattgaaggagatcccatcttgggtctaaaggaatgggggtgaagactgcatcttgtcgttccagttccaccccattctggcatgggaagcatgtgtgggcttctactctatgggagattcatagcctcaatccttaaggaattctcaatctgaaaggaaaacacaaaccctgacctcagggagctcccagtttgacagtggagacagagaggccctgcatcaagtagaaaaacaacccccactgctctcaagcacacagcaatgaagatatgtatccttggtgctacaggcaaatgctgacgatacgacagtgaatacaacatgaaaaaacaagcacacttctcacccctatggagctttattctggtcaggcagaaggagaaggaaatgtaaacatgcaaggtcaggtactgctgtgaagcaaaataaagctgtgggtactgtgcgaaggataggctgtgtgtgtgtgtgtctgtgtgcgtgtgtgtgtgtgtgttgtgcatattaagtcaaaaaatgaatctggatgatcctgggccaggtctgaccccagcattgccactgactgtataatctcaagcaagtcatgcctcccctctgggcctcactttcctcatctgtaaagtgagaccgtggactgaaaggccattgtgatctggcctcagtcttgaccctccaggatctaacacattttgcctctgtgaatttaatggggggaattataggcagcttagaagcagttctgaaggagaacctctctgctccagcaattccctgaggttccaatttttctgttgatgtcacataatgtgcatagatttgcatactaggcccccaaactcccagggaaggcacgtctcaaaaatgtcaacgattagcacaaatgacttgacttatattcaggcctcttcccagagcaaggggaggaagttgaggtcacctccagctacaaagaaagcagaattctttgccctgaagaggcagagagaggagccctgcttcttctcctctccctggtgccctccagcccattccctcatctctgctcagacacccctggctggactccccaacaaatgcccagggggacctcctaaagacctactccgagtcacttgatgactttgcctaagcccctaacaggagctgcgtgaccctgccctgccctgttagtgtccagagcagcagctttcagggtttacagaagcctgggggatccagagcacctccaactccagtcccgccacctcagcccatgccaggccaatcctagaggctccaacctctaatacctcccaaggtaatgggaatcctaatgcctttcttttctctgcataggcttaaaccagatggcccatgacaagcccttccaattcccgtgtcccagagatg

SEQ ID NO: 465340 - DNA, 3277 bp, Homo sapiens
tgctgtttccgctgcctgcaacactgttccctgccttttcacctccctcacacctgcctgttcttgagcatcccagggaagcgtccactgatgccctaatggtgcatccacgtcggacacgctccaagcccaagtcctctcccctgcgccatctgggctggagtttcagtttgtttgtatagttttttgggttctcctcttttcctgccaggttttaagctttttgtcagcaagaaccagccctattttattcagccctggagcggcctctccaccaggcacacagcttagcacaaagcaggcctcagatgcacgctggacaaatgtgctggtatcctctgcatccttatggccagcatgatccatccagaaacccagtggaactgagccgcgagctggattccagctcacagaacacaccaagaactctggtgaaacatcaagaactctggggggtccccccagaaaaatctggggggcactgcagagcttctgacacggctctgggggaaatcccacacggatgggcagctgcctgcatctggcactgtggaggtgggcgggcagccatggaggatggggagactcatctttctagacttctcctggggaccgcatttcctccagcctccaggtccagaccaaaatagaatgaggtaaattcagcccctttcctgaagcacactcaaggaataaacaagcaccacaaatacagtcttcgggctgggtcatctttccaacctcatttttttttttttttaagagaaccacaggctgttttaagattccaaacccagagacagaaaaagtgcagcaaagcagggcgacaaggggaaagaaacttgacagtgctttgcagacagaaacaagtgacgcaatttccaaattcaagattctcaaaaacagaggctgggttggaacatctagagaaggccagagcgggctgttctaagacttattctcacggtagcatcctgaagccgggggggtccaggaagggggcaggctgaggacatcagcttgcacttggtaggccctcaccaggtcccagaagctgtgccggtgccaaagctgccccttgccaggaagccctcccggctgccctgtgtggttgacacttggcctctgtcatgcttcagtgaccccagaggcaggtcctgagtcaaggacttgaatgcaagtagtttgtctgagaggtgaccccaggaaccacctggagagggcggggaagtaaggcaagcttggagattgtcaaaacagaacactgtgggcctgggacttcagcccgtcagaacctcctggagcagctccagaggggtgcacctgaggacgagggcgctgtctcctgagggcgagggggctgtctcctgagggcgagggggctgtctcctgagggcgaggggctgtctcctgagggtgaggggctgtctcttgagggcgaggggctgtctcctgagggtgagggactgtctcctgagggtgagggggctggggaattctccatagaccttgactccgactcctcagtgggtcagagaaagttccccgcagagctcccacataggggaaggtgtgtggggaggggaagcctcgaggtctgcggctcagcgggtccatctctccgaggaggagtggaggccctgtccaaggtggcagttggtgaggctgacatggtgggagtcaccacctgagcagccagacatgggctggaggagaaatgctgtctacattcatggcagggacccccgccaggacaacctgtggtggcatctgcagagaaaagactcaaacaccagtgatgctggggaagctggaggatccctcttatgtccaggagccagactagggcctcagagatgcttttcctactgcaccgtgagcccccgcatgtggaacacccaaggggaaagggatggaggcaggactcagctggagaaagctttccaaggagaatgaccatgacaggtttgttgggaggctcctggttccagctctcaatcccacttgcaaacctgactcccaaaccaccccacccaccctctcccacttccgggacctgtgggttcaaccccagagcaagaggctgagcccgctccctaagcccacagcatggaggggaaagagcctgctattgaggacacctcaagtgccatctttaaagcgcccctaactaggccctggggaagagttaggagacaaagaacccttaccccaaaaaggctcttataatctcatttccactcaagaagcaaagccacatggagtgctctgtgccaggcactgaggtcgccatagctgaaagcccaggggttacaaggactccagtctggggaccccgtgtggctgtgacccacgtcactcaagttcagaagacatcgagccacagccagagtgagacagctggaaatgaggctggggctgaaaggtatctgtataaagatacctatcaacacagatatcaacagacatctgtatccagggagatggcaaggccagggccggcttcatgggcatctgacccgtgcagtcacacagggcccgacacacagaatcagggcctagttagaggcccttttaaagatgggaccctgacaatatctggtgacatttttggtttcacaactgagtgtggggatgtgtcattggcatctggtgggcagaagccagggctgctaccgaatgccctactatgcccaggatggcccttaaccccagagaatgagccacccccaaaggtcactactgcggaggctcggaaaccgaaaccctgcctcaaatgacagggtataaacacttcagctctcttgacgggactagggtgagggtgcaactttgtctccagaacctctagcaggaagagtgagccaaagtcacccttcggggtgctctgcgcagcaccgctccctcacctggcctccccatctccccactgcccgatgctcctaaaggcctttcctggaaacattttctaatccttcactctcacagccacacaatcctcagctgagggtgagctttggagaaacctgacctgaaaccagtggccaacaggtttcacttgatggcagcttcactcaactggcagtggctgccttatttagagacctgtaccaaggatccagggaaagggagggaaagggatccattagcaatgcctgccttggtcccaggaggagaagggtggcatgcgtgctggaatgcaagaccaggtgtcagctttccttcctcctttcttggggtggcaaaatggaaagccatgggcattgttgaggaaaaa

SEQ ID NO: 465341 - DNA, 3066 bp, Homo sapiens
tcaaagtccacttgcaggattatgtgccaggactgccctctcccctacaagcccttccaggacctggctggctgtgcagggtgccgacacaggaacaagctctatgcagggcccatagccagactaggcatgtcgcctcaaggggaatgtggcagcgaccatgcgagggtgactgtgaccctgaagccccagaaaggggtgttacggtgttcctttagttctgctgtccatggatggtggaggctgtggacagtaaaaagacatgcagcaccaaggcaggggagaggagagtgctataaacagaccttggctaccgaaaagcaggataaagccaaagccagtctgtcccctcctgatgtctccctaggggacaagtccttgaggggacaactgaagcgcaaaataggcattttcatctacaactcttcatcttctatagaacaacattgaagtttcctgattaccactgattgattttctgtgtggagttctctgccacgacctgatagaatattggaaattatttaagatagtaatttgagaataactaataataaacccttctcactgatggcattgacagtaattaggccactgagccaattgtgtcttgagactagtcctagttgcattatcaagagcaactttctattcacaacagccacgaaatattcattgaattcttctaaaagcagcgtcatatcatgcacatgtattttataggaaagttaaaaaacaactttcacatcgtcaaaataattgccaatctgccaggctcgtgcctgccaactctggttcttattggatttttaaatgtgaatcatgtatccataactgtgagtccacattaatgttctgccagagcctggcatcagcctctgcatagacaatcacaagccaatagagagggaatggaaacagcactctattgatcttggcttatttattcataaactaggaaagcagttgaacagctatgcgagaagcctactttctcttcatgtaacacgttggcctaagagatctatagagctttttaaaaacaaagaaggcagcaagatttaaaataataaaaccagcaataggtatttttaaaagtgagagaaactatcagagagctgtagcagaaaagcaagttaaaaataaaggaaacagaaaaggaactgatacagctgatttgatactggaaaaatcacccaggaggcagcgtggacaatggattggagaagggcgaacattcagtcagagactttgtgagcttactgtaaattagagggagcaaattggaggagaaatgacaaaagaaacagaaaaaatgtttaatcagacaaaggaactaaaaaacctcagtcttaattagaagatggtcaaacaaatctcttaactgatgttcacaatgatggtttcaagtcatctaaggaatgggagaaaatacaactggtgaattgcaaagatattaagaaatttttttcatgacctccaaagaataaaattataaaacttattcttacctttttgtttcctgtaaacgtgtggtatattccccttgtccctcacgacaaacttctctatgatttcctcaatggttaaggccccaaatgatacattaaaaaatatacatttgttttatattttcaaagtattcttaatctttaattaggaactacactgaaactctgttgtcaatgcccctacgaagactgaaagagatgtgatggttttaagactggtgcctatggtcaaaagaatatactgactgcttccaaatgtctataaataaattatggtttcttaaaggcccatgaaatgaaactttatttcttgtcattagttatctaatttcttaaaggttatctttgttaggaatggaatcaatttaatgatttaaatatttttcaaacattttataacacatttttatactagaattcttgtttgctttcaattgcctttctcattctttttactttcattccatgttttccttctgaattataattgtgtattctattctggatgaaatactcatatttctctaaaatgtggctagtaaacaaaaccatgtaagagtgtacataagagggaacctcagatctctttcatctgtgatttttaaagttatccttggctttactaaaccatgggttgctatggctgttgtcattgcagttaaatatagactctaatttagataatcataggataaaacccaaagtgacgtactgtttcaaataaaacactgataccccttcatatacacaatggtgggagagacatactgtatttaacattcaaccagttgtctgggtattgaactctgttatttcagtagtcagtataaacacaaccagagagaagcaaatcagaaggaaaacaacaaagagaagcaaatcagaaggaaaacaacaaaaatttctgcattttgtttcctcaagcaaaaaggccttattaggaaaaaacaaaacacttttactaaatgcaccatattactaaatccaacatattcaggaatgtgtattgtggcatttatctgagagaatcacgtggttggattttacatcttttatcccagcccaacagttgaatggtttgtatatttgaaaactaactataactttagtcgcatttcatagctttttctttgaagtatccttattttaataagtttccaagtaatttgtcctgtataatcttatttcttctttttattttattttattttttaagttccagggtacatgtgcaggatgtgcagtgtgtaaaaagttgccagctgctacagatgtttacagaaggtagttaaaagagacaaactgtatgaattagaaatgttcattaaaacctgccgaggcctcacaagatgaagattaaaaaaaaaaaatttgtccaagcaaactgcaagatcacaagcaagatccatgtcttaccattagtattacaagcaagatctatgtcttaccgttagtgttaagtaatctgaaatgccttaagggtactaaggcaatcatattaaagaatgctttactttttacttaattagagccagattttaattatggggaaaaa

SEQ ID NO: 465342 - DNA, 582 bp, Homo sapiens
gtttgggtgaggcgttaacagtgggcgggcgtggctcgggctcgagggcgtggctcaggctcgtggaggcgtccgagctccagggcagctctggggcagaactgtccggatctaacaatccctggggagccggagaccggtgaccgccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 465343 - DNA, 679 bp, Homo sapiens
gccagtgaagggagaggtgaacggcgtcctttgaagcgggtatcagctgcctcagacccagttagcacagaacttttttcccaagggtaaggctgaggctgtttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465344 - DNA, 669 bp, Homo sapiens
cattcggcacgaccggctcttttaaatgaccccaggcgtgggtacagtgaccgccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagctaaaaaaaaaaaaaaaaaaaaaaaaaacacaaagaaaaaacaacgaaaagcaaaccaaagcgaacagcgcgacacgccagaacacacagcaaaagaagaacgcgggggggccgccccacgagagagagtcgacggacggggggcacacgacagcaccgacctgtagacagcggcgcgcccaa

SEQ ID NO: 465345 - DNA, 606 bp, Homo sapiens
tccctggaattaaaaaatttaaagcaaaatatttgtaagaggagcaaagcagcaacctatataacgtactaaaaaaaacacctataatataaaaaaaaatggtgaaaggattagctattattataataaatggaaaaaagttgccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465346 - DNA, 829 bp, Homo sapiens
ccacaactgtgtctagtacgatgctcggtgtgtaattcggccgaggcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaagtgtaccactggtataaaaatagacagaccagtggaacagaataaagagcgcggaaataaagccaaatactacagccaacagatcatcgacaaggtaaacaaaaacttaaagtggggaaaggacaccctattcaacaaatgctgctgggataattggcaagccacacgtagaagaataaaactggatcctcatctctcaccttatac

SEQ ID NO: 465347 - DNA, 3060 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtaatgcaaactatgttggtggcagtgtgtagctgcaacaccgtaccttcttcacagtcagtgaaggaagctgtgctacaggtgtctgctgagcatctggacaggaactattttctcagcacgtcaaaatttttagaaagtggctgcccttgttggcttccttcttcctacttaagataaactgtgagaggaaaattttgtgtggtgttagaaaattcatgtgtgagaagaggccttgggctccaggacccagtcaggcagccctggacttgaccctaaaagggagtaaagacaaatgcgaagttcaatcaggggttcagagctcccaaagctcatagcctggagcttcttaacctttaggcagggtagagacatttaaaacggcccctaaacttggggggcgcgtaggctcatgggaaatagagtagggtgcttgtcctgggaccagctgtgggccccggaggctgacttccggtgcactcctgcgcgtgtgcacctctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtaggtcttgggttttcgggcccggagcgagaagggcctgagtgaagtcaccgtgtgttggggaccttagagtgtggggcagggggagggtctcgatcgcttgcaggagagacgtgtgtttgggtttgagggcagggtccggctgcaccgaacaggcgctgcatgggaaatctgggaggacgaggcttatgggggcctggagggtgtcaccagcctcagctgcggacgtcgtctccactccccgctaacccctaacagcccttcctcctcctttccgtgctccagatttcgacctcctctaaacgtccgtcagcgcctctgttctctcatttaagtgtctgctgattccccccttagatctgccctggagactggtctaccagccacagtctctgcacgtttccaagagcagcagaaaatgaacacattgcaggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 465348 - DNA, 3115 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggtactctacttggtcttcctgttggggtcacacctcttgactacatcttcacacggccttttctgatgccattaaaaaatggcaggagctatcaccagaaaccagtggaaaaaggaaaaagagaaaagaaatgaaccagtattcttaaattgatttcaagtttgaacaaggtaatgcaaactatgttggtggcagtgtgtagctgcaacaccgtaccttcttcacagtcagtgaaggaagctgtgctacaggtgtctgctgagcatctggacaggaactattttctcagcacgtcaaaatttttagaaagtggctgcccttgttggcttccttcttcctacttaagataaactgtgagaggaaaattttgtgtggtgttagaaaattcatgtgtgagaagaggccttgggctccaggacccagtcaggcagccctggacttgaccctaaaagggagtaaagacaaatgcgaagttcaatcaggggttcagagctcccaaagctcatagcctggagcttcttaacctttaggcagggtagagacatttaaaacggcccctaaacttggggggcgcgtaggctcatgggaaatagagtagggtgcttgtcctgggaccagctgtgggccccggaggctgacttccggtgcactcctgcgcgtgtgcacctctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtaggtcttgggttttcgggcccggagcgagaagggcctgagtgaagtcaccgtgtgttggggaccttagagtgtggggcagggggagggtctcgatcgcttgcaggagagacgtgtgtttgggtttgagggcagggtccggctgcaccgaacaggcgctgcatgggaaatctgggaggacgaggcttatgggggcctggagggtgtcaccagcctcagctgcggacgtcgtctccactccccgctaacccctaacagcccttcctcctcctttccgtgctccagatttcgacctcctctaaacgtccgtcagcgcctctgttctctcatttaagtgtctgctgattccccccttagatctgccctggagactggtctaccagccacagtctctgcacgtttccaagagcagcagaaaatgaacacattgcaggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 465349 - DNA, 1497 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggtctaccagccacagtctctgcacgtttccaagagcagcagaaaatgaacacattgcaggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 465350 - DNA, 2558 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggtactctacttggtcttcctgttggggtcacacctcttgactacatcttcacacggccttttctgatgccattaaaaaatggcaggagctatcaccagaaaccagtggaaaaaggaaaaagagaaaagaaatgaaccagtattcttaaattgatttcaagtttgaacaaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465351 - DNA, 2898 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaaaaaaacacaaaaaccaccatacacaagggaacccctctccaccccccccacaaacacaagagggggggcccccaaaaagaaatccccaggggcccacgacgagaggcagaccccagccatgtgtagacaaggaggggcccacaaggaggtcgctataaaaacaccgaaagcgcggccccccgcaaaaaaccacgccgcccgaagcacaacacaccgcccacgagggacactctcgaggaaagaaccccaacctcctgcggcgggggacacaacagcgaaaaaccccccagagaatgaccacccccgagggaaaaaaacaggtcgcgcgcaatcaaggggccaccacacgcaaaaccgcgacgaaaaaagggcccccggagactatagaacataac

SEQ ID NO: 465352 - DNA, 2568 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggactttgagagtcatcagcatatggaaaatctcaccagccaggatgaggtacccagagataccaggccttttctgatgccattaaaaaatggcaggagctatcaccagaaaccagtggaaaaaggaaaaagagaaaagaaatgaaccagtattcttaaattgatttcaagtttgaacaaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465353 - DNA, 2463 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465354 - DNA, 2280 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465355 - DNA, 1715 bp, Homo sapiens
ctactttttatttagcaaacctctctttcgctgctgttatgtgccaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465356 - DNA, 3240 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtaatgcaaactatgttggtggcagtgtgtagctgcaacaccgtaccttcttcacagtcagtgaaggaagctgtgctacaggtgtctgctgagcatctggacaggaactattttctcagcacgtcaaaatttttagaaagtggctgcccttgttggcttccttcttcctacttaagataaactgtgagaggaaaattttgtgtggtgttagaaaattcatgtgtgagaagaggccttgggctccaggacccagtcaggcagccctggacttgaccctaaaagggagtaaagacaaatgcgaagttcaatcaggggttcagagctcccaaagctcatagcctggagcttcttaacctttaggcagggtagagacatttaaaacggcccctaaacttggggggcgcgtaggctcatgggaaatagagtagggtgcttgtcctgggaccagctgtgggccccggaggctgacttccggtgcactcctgcgcgtgtgcacctctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtaggtcttgggttttcgggcccggagcgagaagggcctgagtgaagtcaccgtgtgttggggaccttagagtgtggggcagggggagggtctcgatcgcttgcaggagagacgtgtgtttgggtttgagggcagggtccggctgcaccgaacaggcgctgcatgggaaatctgggaggacgaggcttatgggggcctggagggtgtcaccagcctcagctgcggacgtcgtctccactccccgctaacccctaacagcccttcctcctcctttccgtgctccagatttcgacctcctctaaacgtccgtcagcgcctctgttctctcatttaagtgtctgctgattccccccttagatctgccctggagactggtctaccagccacagtctctgcacgtttccaagagcagcagaaaatgaacacattgcaggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagctaaaaaaaaaaaaaaaaaaaaaaaaaacacaaagaaaaaacaacgaaaagcaaaccaaagcgaacagcgcgacacgccagaacacacagcaaaagaagaacgcgggggggccgccccacgagagagagtcgacggacggggggcacacgacagcaccgacctgtagacagcggcgcgcccaa

SEQ ID NO: 465357 - DNA, 6716 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtaatgcaaactatgttggtggcagtgtgtagctgcaacaccgtaccttcttcacagtcagtgaaggaagctgtgctacaggtgtctgctgagcatctggacaggaactattttctcagcacgtcaaaatttttagaaagtggctgcccttgttggcttccttcttcctacttaagataaactgtgagaggaaaattttgtgtggtgttagaaaattcatgtgtgagaagaggccttgggctccaggacccagtcaggcagccctggacttgaccctaaaagggagtaaagacaaatgcgaagttcaatcaggggttcagagctcccaaagctcatagcctggagcttcttaacctttaggcagggtagagacatttaaaacggcccctaaacttggggggcgcgtaggctcatgggaaatagagtagggtgcttgtcctgggaccagctgtgggccccggaggctgacttccggtgcactcctgcgcgtgtgcacctctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtctaccagccacagtctctgcacgtttccaagagcagcagaaaatgaacacattgcaggccagtgtcattcaaagatgtggctgtggatttcacccaggaggagtggcagcagctggaccctgatgagaagataacttacaggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacgaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatattataaaaataagacaaggatatctgctgtcaatgattttattcggcattgttcagaaggacctaaccagaaaactaatgcaaggaagagaaacaaaaggcatagagattagaaaagaagtaaaactttaaaaacgaaaaagaatataaatctctatttgcagatgccatgagtaaatttgtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatcacgttttggcaaggatgtaagcaagaggaactgtacactactggtggaattgctcatcgataaaaccattttgaaagctggcactaaaagccaagcatatgtatactgttttacccaaacccagcaaaaatgcatgtgtctgtccaccaaaggacatgcactagaatatttatagcctaaaactgcacaaaacagaactatcttaaggcacatgtgcaatggaatgaataaagaagtggcatatgtccatggaatactgtaaaacagtgagcatgaatgaactagaagtccgtgtaataacgcagctgaatttaacaaaccttgctgaatgaaagactccagacacaaaagccaacatgctgtatgattccttctatataaattataaagacgggcaaaacttgtatacgtggtttaaaattagggtagcagttagccttggccaaggctgaaagggggcatttatctggtgctgggaataatctgtttctaaacctaggtgctaagtatttgagtgtgttttgagctgtgcacttaagatatgtgtatttttctgcatgtgtgttaaactttccataaaagttttctaaaatcacaaatggctaacatttgtgtcgctcatcactctaatcatatttttctagatgtgtatgaatatgctgcacaacaggaattaaatggcagattttgcataattctgtgcaggaaatacatatttatagtaattttgatggcaactactaagatttcctacgctgtccttaaagcttagcataatgtatattttaagtgaaatatttgagaaggttaaagaatcattacatactttgtcatcctatacttttgcatatataaataggtctgagctgcctcttcaataaagaagctaatgtgtaacatttcatatttccctaaacaaattgttttttgcatttctgaattcgggattcatcttaacttttactgtaggggtgacctttcttggcagtgaatgaatataatgctgagttggatttgatggaaaattattttaaaagtattcagctaaatatttgagcaaatctcagatacacagttaacagcccagatgtaa

SEQ ID NO: 465358 - DNA, 1041 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaagtgtaccactggtataaaaatagacagaccagtggaacagaataaagagcgcggaaataaagccaaatactacagccaacagatcatcgacaaggtaaacaaaaacttaaagtggggaaaggacaccctattcaacaaatgctgctgggataattggcaagccacacgtagaagaataaaactggatcctcatctctcaccttatac

SEQ ID NO: 465359 - DNA, 760 bp, Homo sapiens
ccacaactgtgtctagtacgatgctcggtgtgtaattcggccgaggcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaaggagtgccttctctagaactgctagcatgtcagatcagctcaagcatgaggtcatatgaagacgtgggcagactgaagtccgacaggcttccccactgcttttgccccagggtgcagatattagaacagaggctaccacttgtttctgtagaagaaaaactttgtccttcatttcctgtgcctccaaatgtcacttaacctccagaagagttctgttgactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggcccggaggactccaagggccatacaattcccaaaggagtgagaagaataaattggaatatccccccaataggacta

SEQ ID NO: 465360 - DNA, 386 bp, Homo sapiens
ctggagtactagcctggcttacttttgcaggagtgccttctctagaactgctagcatgtcagatcagctcaagcatgaggtcatatgaagacgtgggcagactgaagtccgacaggcttccccactgcttttgccccagggtgcagatattagaacagaggctaccacttgtttctgtagaagaaaaactttgtccttcatttcctgtgcctccaaatgtcacttaacctccagaagagttctgttggtaagcataatgaagggattaaactagaaatgaattttgacagtttatagtgagagcttctgatttctgccatgtggaacttcatgtctgtagcatttcagtatttgaagttcttaatattgttgcaaatataaaatga

SEQ ID NO: 465361 - DNA, 762 bp, Homo sapiens
gtttgggtgaggcgttaacagtgggcgggcgtggctcgggctcgagggcgtggctcaggctcgtggaggcgtccgagctccagggcagctctggggcagaactgtccggatctaacaatccctggggagccggagaccggtgaccgccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagctaaaaaaaaaaaaaaaaaaaaaaaaaacacaaagaaaaaacaacgaaaagcaaaccaaagcgaacagcgcgacacgccagaacacacagcaaaagaagaacgcgggggggccgccccacgagagagagtcgacggacggggggcacacgacagcaccgacctgtagacagcggcgcgcccaa

SEQ ID NO: 465362 - DNA, 7224 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtaatgcaaactatgttggtggcagtgtgtagctgcaacaccgtaccttcttcacagtcagtgaaggaagctgtgctacaggtgtctgctgagcatctggacaggaactattttctcagcacgtcaaaatttttagaaagtggctgcccttgttggcttccttcttcctacttaagataaactgtgagaggaaaattttgtgtggtgttagaaaattcatgtgtgagaagaggccttgggctccaggacccagtcaggcagccctggacttgaccctaaaagggagtaaagacaaatgcgaagttcaatcaggggttcagagctcccaaagctcatagcctggagcttcttaacctttaggcagggtagagacatttaaaacggcccctaaacttggggggcgcgtaggctcatgggaaatagagtagggtgcttgtcctgggaccagctgtgggccccggaggctgacttccggtgcactcctgcgcgtgtgcacctctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtaggtcttgggttttcgggcccggagcgagaagggcctgagtgaagtcaccgtgtgttggggaccttagagtgtggggcagggggagggtctcgatcgcttgcaggagagacgtgtgtttgggtttgagggcagggtccggctgcaccgaacaggcgctgcatgggaaatctgggaggacgaggcttatgggggcctggagggtgtcaccagcctcagctgcggacgtcgtctccactccccgctaacccctaacagcccttcctcctcctttccgtgctccagatttcgacctcctctaaacgtccgtcagcgcctctgttctctcatttaagtgtctgctgattccccccttagatctgccctggagactggtctaccagccacagtctctgcacgtttccaagagcagcagaaaatgaacacattgcagtgttttagttttgtccttttcacgttgctgagtcagtctgtaaagattaccagtgatttcattgcagtcaaatccagaggggatttcctagcccctacctcccaggaccctttgtctgcctttgacatctgttacttccaaactgatactttctccatggagtctctcttttcttggcttttaaaaagattcgtctgccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacgaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatattataaaaataagacaaggatatctgctgtcaatgattttattcggcattgttcagaaggacctaaccagaaaactaatgcaaggaagagaaacaaaaggcatagagattagaaaagaagtaaaactttaaaaacgaaaaagaatataaatctctatttgcagatgccatgagtaaatttgtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatcacgttttggcaaggatgtaagcaagaggaactgtacactactggtggaattgctcatcgataaaaccattttgaaagctggcactaaaagccaagcatatgtatactgttttacccaaacccagcaaaaatgcatgtgtctgtccaccaaaggacatgcactagaatatttatagcctaaaactgcacaaaacagaactatcttaaggcacatgtgcaatggaatgaataaagaagtggcatatgtccatggaatactgtaaaacagtgagcatgaatgaactagaagtccgtgtaataacgcagctgaatttaacaaaccttgctgaatgaaagactccagacacaaaagccaacatgctgtatgattccttctatataaattataaagacgggcaaaacttgtatacgtggtttaaaattagggtagcagttagccttggccaaggctgaaagggggcatttatctggtgctgggaataatctgtttctaaacctaggtgctaagtatttgagtgtgttttgagctgtgcacttaagatatgtgtatttttctgcatgtgtgttaaactttccataaaagttttctaaaatcacaaatggctaacatttgtgtcgctcatcactctaatcatatttttctagatgtgtatgaatatgctgcacaacaggaattaaatggcagattttgcataattctgtgcaggaaatacatatttatagtaattttgatggcaactactaagatttcctacgctgtccttaaagcttagcataatgtatattttaagtgaaatatttgagaaggttaaagaatcattacatactttgtcatcctatacttttgcatatataaataggtctgagctgcctcttcaataaagaagctaatgtgtaacatttcatatttccctaaacaaattgttttttgcatttctgaattcgggattcatcttaacttttactgtaggggtgacctttcttggcagtgaatgaatataatgctgagttggatttgatggaaaattattttaaaagtattcagctaaatatttgagcaaatctcagatacacagttaacagcccagatgtaa

SEQ ID NO: 465363 - DNA, 2503 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465364 - DNA, 2395 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465365 - DNA, 2926 bp, Homo sapiens
gagcttgtaccgctgcactccagcctgggcaacagagcgagactcagtctcaaaaaaaaaaaaaaaaaaactggagtactagcctggcttacttttgcaggagtgccttctctagaactgctagcatgtcagatcagctcaagcatgaggtcatatgaagacgtgggcagactgaagtccgacaggcttccccactgcttttgccccagggtgcagatattagaacagaggctaccacttgtttctgtagaagaaaaactttgtccttcatttcctgtgcctccaaatgtcacttaacctccagaagagttctgttgactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtaatgcaaactatgttggtggcagtgtgtagctgcaacaccgtaccttcttcacagtcagtgaaggaagctgtgctacaggtgtctgctgagcatctggacaggaactattttctcagcacgtcaaaatttttagaaagtggctgcccttgttggcttccttcttcctacttaagataaactgtgagaggaaaattttgtgtggtgttagaaaattcatgtgtgagaagaggccttgggctccaggacccagtcaggcagccctggacttgaccctaaaagggagtaaagacaaatgcgaagttcaatcaggggttcagagctcccaaagctcatagcctggagcttcttaacctttaggcagggtagagacatttaaaacggcccctaaacttggggggcgcgtaggctcatgggaaatagagtagggtgcttgtcctgggaccagctgtgggccccggaggctgacttccggtgcactcctgcgcgtgtgcacctctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtaggtcttgggttttcgggcccggagcgagaagggcctgagtgaagtcaccgtgtgttggggaccttagagtgtggggcagggggagggtctcgatcgcttgcaggagagacgtgtgtttgggtttgagggcagggtccggctgcaccgaacaggcgctgcatgggaaatctgggaggacgaggcttatgggggcctggagggtgtcaccagcctcagctgcggacgtcgtctccactccccgctaacccctaacagcccttcctcctcctttccgtgctccagatttcgacctcctctaaacgtccgtcagcgcctctgttctctcatttaagtgtctgctgattccccccttagatctgccctggagactggtctaccagccacagtctctgcacgtttccaagagcagcagaaaatgaacacattgcaggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 465366 - DNA, 489 bp, Homo sapiens
cattcggcacgaccggctcttttaaatgaccccaggcgtgggtacagtgaccgccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 465367 - DNA, 2424 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaagaaggaacctttccctttctcaatttttaggccttttctgatgccattaaaaaatggcaggagctatcaccagaaaccagtggaaaaaggaaaaagagaaaagaaatgaaccagtattcttaaattgatttcaagtttgaacaaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465368 - DNA, 2451 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagaagactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctctaa

SEQ ID NO: 465369 - DNA, 1138 bp, Homo sapiens
  misc_feature (1)..(3): n is a, c, g, or t
  misc_feature (7)..(7): n is a, c, g, or t
nnncctncgcctcgtgggggagtcaagtctccgtaggcggagagcccggatgcaggcgcggctaggcggccctctctatggtgagccccccggtccctcctccgcagcacccggagtgcctctatggttcttcctgtcgttagtcgggagggggcgctgtacgcgcgctgtacgcttgcgcgaggtgacgccggggcagggccggaaggaatgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtggaaaaaggaaaaagagaaaagaaatgaaccagtattcttaaattgatttcaagtttgaacaaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtttcctggggacacgagcatgaattgtaataat

SEQ ID NO: 465370 - DNA, 3403 bp, Homo sapiens
ttgtcactgctttaggagttcttcattgatttcgaacagacattttaagatagttttttctagcttgtgttgtgtttttaatgggagagttggtcagcgtctgctggaacagagctacgcctatggaaccgtagacttgttcgtgctttattgcaatactttaaagacacaaagtctcaacaaccatcttccgcttgacgagacagatcattctaatttgagcagaagctactatgtcctgccctttgaacgcggcggcccggacagctgacaaggacacactgtgtatttccattccaattctgggagtgctctgaggcctctgggggagaaggacccatgaaatattcaaaacataagtgaataaaatatctaggtgctagatatgggccaggaagagccctcggccctgcaaagtgtgtgtgatggtgagaagctaccggaagagatggtccctgtgcttggttcattccttggacatttatcaagctgacgaatgtagcagaggtgcttcagtcggctgtaattccacgggtggagtgctggctggagagttacctggggctgtcacactgcatgggctccgggacactgtggctgcccttatgtggtgtccccggagggccctgcaggtgtcacaccgctgctccacactgccacctgctgtcagcatctgtgcaacgtatccaggtctctgggggctagaatgaaaaacatgcatctcgtaaccaatgaaatcgggcttgtcctgaagacctcgtgcattcatccattctcacactgctataaagacatacctaagactgggcacttcatgaagaaaagaggtttaattggctcacggttctgcaggctttacaggaagcatagcagcttccacttctagggaggcctcaggaaacttatagtcatggtggaaggtgaaggcgggacaaggcgtctcacatgggagcagtagagagagaaaaagagggggtgccgcacactttgaaacaaccagatctaacgataactcactatcatgagaacagcaccaagaagctggcgctaacccacttgtgaaggaccaccaccatgatccaatcccttcccaccaggtcccacttccaacgttggggattacacttcacgctggctgcacgctgggcctccgggaagccggcaagcccacctgattctggatcctccctccgagcctgggtgacgctgtcatgaaagaagctgccagaagcccacagcagggcagttaggcagggaatgcgagtccgtgtccagagcaagggtgactccagtccctccaggacggagaagccacttggctgggggatgtggggccactgggctggggtggttgggcagcggcttagcttcaggggtgaaggggagctggggctgctaccccaggaacaagatacactccagcagtagttccagttccaagagggcaccgcgagggccacgggggcaggcacagtgtcgattccttctccggcgggagcacagtggtgtggcctccaggcagctcactccaccctgggcttcgtgcctgtgaggactgcaagggaccccaaggtgcagtcacacgctgcacgggcgtctggctacacaaatgccaccgcgttacagtcgcctgcagtattcagtgcagtcacacgctgcacgggtgtttagatacacaaatgccaccccgttacagataattctgccaaacgaaagatgtcagatgaaaaagtctacacagtataatcccgtgtatccagaatcctacagcaaactcaccaacagtggcaggaagcagacctgcgcttgctgtagatgcaggacaggatcctgtgaagactcaagacttgttgtggacagatgcctccatctcttgggcacacacctagaaggagcattgctgggccatagggtggacatacgtttagctttattagaaattgtcaaaatgattttcaaagtgattgtaccgttcacactcccacagcaacatacagaacttcctactgctccccgtcctcgccggctgacgcttggtattgtcagtctttttaatgttcgtcatcctggtgggggtgtggtggtatctcactgtggtgttaatttgcattcctctgatgaatgctgattctgtgcacgtgttcaatgcttagaactgcccggataccctctcctgtgaagcacctgctcaaggcactgtcaatgtttagggctgcccggataccccctcctgtgaagcacctgctcaaggcactgtcaatgtttagggctgcccggataccccctcctgtgaagcacctgctcaaggcactgtcaatgtttagggctgcccggataccccctcctgtgaagcacctgctcaaggcatgtcaatgtttagggctgcccagataccccctcctgtgaagcacctgttcaaggcactgtcaatgtttagggctgcccggataccccctcctgtgaagcacctgctcaaggcactgtcaatgctttagggctgcccggataccccctcctgtgaagcacctgctcaaggcactgtcaatgctttagggctgcccggataccccctcctgtgaagcacctgctcaaggcactgtcaatgctttagggctgcctggataccccctcctgtgaagcacctgctcaaggcactgtcaatgctttaggactgcccggataccccctcctgtgaagcacctgctcaaggcacagtcaatgcttaggactgcccagataccctctcctgtgaagcacctgctcaaggcactgtcaatgctttagggctgcctggataccctctcctgtgaagcacctgctcaaggcactgtcaatgctttagggctgcccggataccccctcctgtgaagcacctgctcaaggcactgtcagcgatttagggctgcccggataccccctcctgtgaagcacctgctcaaggcactgtcagcgatttaggactgcccggataccccctcctgtgaagcacctgctcaaggcactgtcaatgctttaggactgcccggataccccctcttgtgaagcacctgctcaaggcactgtcaatgcttagggctgcccagataccctctcctgtgaagcacctgctcaaggcactatcaatgcttagggctgcccggataccctctcctgtgaagcacctgctcaaggcactgtcaataccttccttcggttgttgctttcttaattatttgtaattctttatctatctgtacagaaatcctctgccatataaatgtattacaaacatcttcaccagattctggcttgctctttcattgtcttgacggtgtctcttgatgaatttgtagtagatatagtattgtcatagatattcagagtttttatatttgctgtgtcagttttggtaggttgtgttttt

SEQ ID NO: 465371 - DNA, 3372 bp, Homo sapiens
tgattctgaggcctccccagccatgtggaactcttgtgttgtgtttttaatgggagagttggtcagcgtctgctggaacagagctacgcctatggaaccgtagacttgttcgtgctttattgcaatactttaaagacacaaagtctcaacaaccatcttccgcttgacgagacagatcattctaatttgagcagaagctactatgtcctgccctttgaacgcggcggcccggacagctgacaaggacacactgtgtatttccattccaattctgggagtgctctgaggcctctgggggagaaggacccatgaaatattcaaaacataagtgaataaaatatctaggtgctagatatgggccaggaagagccctcggccctgcaaagtgtgtgtgatggtgagaagctaccggaagagatggtccctgtgcttggttcattccttggacatttatcaagctgacgaatgtagcagaggtgcttcagtcggctgtaattccacgggtggagtgctggctggagagttacctggggctgtcacactgcatgggctccgggacactgtggctgcccttatgtggtgtccccggagggccctgcaggtgtcacaccgctgctccacactgccacctgctgtcagcatctgtgcaacgtatccaggtctctgggggctagaatgaaaaacatgcatctcgtaaccaatgaaatcgggcttgtcctgaagacctcgtgcattcatccattctcacactgctataaagacatacctaagactgggcacttcatgaagaaaagaggtttaattggctcacggttctgcaggctttacaggaagcatagcagcttccacttctagggaggcctcaggaaacttatagtcatggtggaaggtgaaggcgggacaaggcgtctcacatgggagcagtagagagagaaaaagagggggtgccgcacactttgaaacaaccagatctaacgataactcactatcatgagaacagcaccaagaagctggcgctaacccacttgtgaaggaccaccaccatgatccaatcccttcccaccaggtcccacttccaacgttggggattacacttcacgctggctgcacgctgggcctccgggaagccggcaagcccacctgattctggatcctccctccgagcctgggtgacgctgtcatgaaagaagctgccagaagcccacagcagggcagttaggcagggaatgcgagtccgtgtccagagcaagggtgactccagtccctccaggacggagaagccacttggctgggggatgtggggccactgggctggggtggttgggcagcggcttagcttcaggggtgaaggggagctggggctgctaccccaggaacaagatacactccagcagtagttccagttccaagagggcaccgcgagggccacgggggcaggcacagtgtcgattccttctccggcgggagcacagtggtgtggcctccaggcagctcactccaccctgggcttcgtgcctgtgaggactgcaagggaccccaaggtgcagtcacacgctgcacgggcgtctggctacacaaatgccaccgcgttacagtcgcctgcagtattcagtgcagtcacacgctgcacgggtgtttagatacacaaatgccaccccgttacagataattctgccaaacgaaagatgtcagatgaaaaagtctacacagtataatcccgtgtatccagaatcctacagcaaactcaccaacagtggcaggaagcagacctgcgcttgctgtagatgcaggacaggatcctgtgaagactcaagacttgttgtggacagatgcctccatctcttgggcacacacctagaaggagcattgctgggccatagggtggacatacgtttagctttattagaaattgtcaaaatgattttcaaagtgattgtaccgttcacactcccacagcaacatacagaacttcctactgctccccgtcctcgccggctgacgcttggtattgtcagtctttttaatgttcgtcatcctggtgggggtgtggtggtatctcactgtggtgttaatttgcattcctctgatgaatgctgattctgtgcacgtgttcaatgcttagaactgcccggataccctctcctgtgaagcacctgctcaaggcactgtcaatgtttagggctgcccggataccccctcctgtgaagcacctgctcaaggcactgtcaatgtttagggctgcccggataccccctcctgtgaagcacctgctcaaggcactgtcaatgtttagggctgcccggataccccctcctgtgaagcacctgctcaaggcatgtcaatgtttagggctgcccagataccccctcctgtgaagcacctgttcaaggcactgtcaatgtttagggctgcccggataccccctcctgtgaagcacctgctcaaggcactgtcaatgctttagggctgcccggataccccctcctgtgaagcacctgctcaaggcactgtcaatgctttagggctgcccggataccccctcctgtgaagcacctgctcaaggcactgtcaatgctttagggctgcctggataccccctcctgtgaagcacctgctcaaggcactgtcaatgctttaggactgcccggataccccctcctgtgaagcacctgctcaaggcacagtcaatgcttaggactgcccagataccctctcctgtgaagcacctgctcaaggcactgtcaatgctttagggctgcctggataccctctcctgtgaagcacctgctcaaggcactgtcaatgctttagggctgcccggataccccctcctgtgaagcacctgctcaaggcactgtcagcgatttagggctgcccggataccccctcctgtgaagcacctgctcaaggcactgtcagcgatttaggactgcccggataccccctcctgtgaagcacctgctcaaggcactgtcaatgctttaggactgcccggataccccctcttgtgaagcacctgctcaaggcactgtcaatgcttagggctgcccagataccctctcctgtgaagcacctgctcaaggcactatcaatgcttagggctgcccggataccctctcctgtgaagcacctgctcaaggcactgtcaataccttccttcggttgttgctttcttaattatttgtaattctttatctatctgtacagaaatcctctgccatataaatgtattacaaacatcttcaccagattctggcttgctctttcattgtcttgacggtgtctcttgatgaatttgtagtagatatagtattgtcatagatattcagagtttttatatttgctgtgtcagttttggtaggttgtgttttt

SEQ ID NO: 465372 - DNA, 5099 bp, Homo sapiens
cacagcagcagggtttctgggtggcagctagtatgtggctgtgtataggattcggtggtggtttagattggtaattccatcatggctggacattagaatcatcttggggagctttaaaagtcatgggcggcaggagagacagctcatgcctgtaattccacactttgggaggccgaggcaggtggatcgcctgaggtcagtagtttgagaccagcctggccaacatggtgaaaccccgtctctactaaaaatacaaaaattagccgggcatggtgatgggtgcttgtaatcccagctactcaggaggctgaggcaggaaaatcgcttgaacctaggaggcggaggttgcagtgagcccagatcacagcacttcactccagcctgggcgaaagagcgaaactcccatctcaaaaaaaaaaaaaaaaaaaaaaaaaaaaaaaaaaagagagagagaaagaaagaaaaagaaaaaaagaacagatctattcaccaaagagctaaagaaaccttcagagagtcttcccctgcccctcttctcaaacccctagggggagcatgcagacaggcaagtctagcgcggccgtgctctcctccgactgccctctgccgaatcccccttggcgtccgtgttattccatcattgatggcctgccagcgtctgtcagtgtgtttttctgccagtgtgttcctctcgatgtccagctgcttgtgtgtgcaggtcatgaaactgttggtcaagagattttctgtgttgctgccttagtagattatgaatacagaattctcccattgaccacaaaggccattgaagaaaaaccctgtggtaaagaatccaagtctgagaattccaactgtgaaaaagcagacttagagctgtaccagcttctgaccctgaactgtgttctcatattcgagaagaaacttggaaaatctccatttaacaggatctattatttgaagatagttgggaaaccatctttaattccttgaacttaccttttgagttttaaatgactctaaatgtgtcattggctgtttcttcctaacgcatggcctgctgaccccaagaggattcctggtgaacatttcatgttctccatctagttacatatgtatttactgatatggaaaagcactgtggggcaatggacacagcactgaccagggagacctgggttctatttctggctcttcctcttagcagctgcatggccctggatagattatttatcttctctggatgtcagtttacaaagcttagactaagagggtgtttctcgaaggaccaacataactctttccactcccacaattcttagttcttcattggttttatgctttgtggtgtggataacactgggttttctactatcctcctttccaaaaaagcaaatgaacccaacactggattcaagcttaaggtgcagactcacagaatattattattttgatgtatatcagctgcatttctttaaggtaaatttaagagctgttttttcttttaaaccctagttggatttttcaggtgtcttgtaaaagcaaaactaccatatttggctttgtagggctctgccaagggtgggctagagggagactgcacggggagaggaggaagtaattactcttttctgtgtgcttcctgtggacttcctgtgtgcttcctgtggacttcctgtgtgcttcttatcctattgacttgctgtggatttcctgtgtgcttcctgtgaacttcctgtctgcctcctgtggacctcctgttggcccatggtggatttcctatcttcttcctgtggattttttgtgtctacttccgatggacctcattgtggcttgttgtggactgcctttctgcttcctgtggagttcctgtgtgcttcttgtggactttctgtctgcttcctgtggatttccagtgtgtgtcttgtggatctcctgttgtcttgctgtggagttcctatggacttcctgtgtacttcttgtggacttcctgtgtgcttcttgtggacctcctgttggcttgctgtggacttcctgtcttcctcttgtggactttctgtgtgcttctcatgtatttcctgtttctttgctgtggactttctgtgtgcttctggtggacttcctgtctgcttcctgtggacgtcctgtctgcttctagtagacctcctgtcatcttgctgtggatttcctgtgtgctttctgtgaacttcctgtgtgcttcttgtgaactttctgtctgcttctgttggacttctgcttcccgttcttgccaagtgccacccaagaagcactgttttactccggcggtggccaatcctttcggtagtagtgactgaattcagtttgtagtttctctggtgtttgcagacaaacttcattatgtcccactctgagacaccagcattgatcattctcctctccttagaggttagagtcccaaccccacagtagctccttttcgaagcttcaaggttttaatgattccagcctcttctctttgttcccccagccttgggagtcctgggagtgtttactgctttgtgtagttgctaccactatggtaacttccagttacttagtcaacaactctatacccagttaataacttctttttattaaattctttctatgcaaataacttttgtgatttccaattccttactggatgtggctgatacaacacttttaacaggttggtttgtaagattctgattttttgtatgcatttagggacacacacataatctgtgtttacttatgactatatgactttatttttacagaagtggcatcatattgtttgcacaatcttctgcaactttctttttatcacctaattttaaatataaataagaaataagaaataataaaaaatgagaacatattcaaaaatgactttccatgtcagtacaaatgaagcttccttatcatttttcatggctgcatagtatttcataatttgtttaatgatgaccactcctagaacttttgattgtttctattttttttgcaattacagaaaaatattttagtgaatatgcttatacacaaatatacacagacaattcttgggtacatgtttgagtatacatctttaagatacatttctattatggaaacagtataaataacatgcgtattaaatatttttgatacatgcagccaatgccccccaaaaatgctttaccatttgacattattatcagctaagtatgattatgcacatctgctctctcttttttatgaattcctaaaagtttctggtctgctgatggtacatttttttatattctagcaatagtattgattttctgttttttcctgggcatgaggagtgaccaaagcaagtgctcagctggcatctcgatccaattttttcagatttcagttttcttcagtggccttggtggattcaataaatcttcaggtagtctactgccaattaccttgttttcatggcagtcttgaaaatgttttggatttttctggctcaggcaaaaggctttaaacatttctttctagaaaggtctgagttataaatctctgaaaactgggtttatgatggaaagtaataatacatttcgagatgcttcctggatcttaaatcattctgataataatgtttaatctatgatttaaataaaatattttcaaaaagaaaaaaagtcactgataattctaccacccttctatggaaagcccgtggcgtaattcagtctaagcctgaagacctgagaatcaggggagctgatgatgttaactcctggtttaaatctgaaggcctgagaactgggggtgccgctgctgtaagtcctagagttcaaaggcccaagaacccagagctctgatgtctgaaagcagaagattgatgtctcagctcaaaaagaaagtgttaatttgccctttctctacctttttgtaccattcaggccctcaatggattagatggtgtccttccacattggtgagggccaatcttctttactcggtctgatactgactcaaatcctaatctcttccagaaacatcttcatagatgaacccggaaataatgttttactagccatctgggcatcccttagcccagtcaagttgacacataaaagtaatcatcacattggtatatgaagaggattaaatcactcaattttgaatagcctctgactcatctctttgccttctgagttctcactcattccctgctctggtccacccagcaggagtccacatggccagcatttctattgagtttacgcagactcacagaaaggaaccactgataggaaggccacgggcactgttttaatggtggaatcattccacatctgtgaataaaatgctacagaacctttagggctagcagccgtctcagaggacttctgatgcaatctttctcctatggactaccggcaaagagaataaccctaaacccagatgtgatgataaaaggcaaaaggtgatgttttacaaggtagaaaaagagatatggaatttagagtaggggaaataggcttgtcttcagaacctaggactgtaaaagccttgttatggaaaatggttctaaaaggatttctttcctatgaaaatgatatgaaaatatatcgttccaagagactggactagaagtcttccaaactgtcttctagtgatcctgaattatcagagtttatgtcttctatgaaaggggactgaacatttcctttctattgatcccaggtctttagacaaactgaacccattgtcatccagaaaatgtttacatttgcctatagcctggaagtccccctccccttcccccctccccctccccttcccccctccccatccccttccccctccccctcttcccttcccctccccctcttcccttcccctccccctcctcccctccccctccccctcctccccctcccccttctcccccttcccccccctttcccctcttcccttcccctcttcccttcccctccccctctcctccccctcccccctcccctcccccactttgagttgtcccacctttttggaccaaactgatgtatttcttaaatgtatttgactgatgtctcatgtctccctaaaatgtgtaaaaccaagctaca

SEQ ID NO: 465373 - DNA, 2167 bp, Homo sapiens
cagagctctgctgaaacccagatccacgaggcgacagctgctcttggccaaccacgccccctccacccccacagccacttccacatctccatcagttcctccttgtgggtccgaggcgctctgccgccggcccctcctcacttcttcctccctggggatggatccaagctattgtcctgcccatggcttcccatctcaggacgctctctggccgctatcatcccagcagtggagttcagcccactactctgaaccagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggagcgcagaggccatggagccggagctcgcggacacctctgcactcaaggcggcgcctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggccgctgtgaaggtgaacctcacttagtggaattttcgagctggcagggtcccagacacctcatgtcacaaatcgggagagaaaccttcccaccctctgagggtctgcacgggatcccaggaggagcccagcccctcaaggatagtgggcagggatcatgggccctcagtggggactgtccactcagtggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaaggcaagtgtgcccagccccggacctgcccctgaccacacccacctgtacccacagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccaggatgtggccagcccaggtccccactcacgccctgccgtcgccttgttgcagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagccc

SEQ ID NO: 465374 - DNA, 1991 bp, Homo sapiens
cgggcccggggagcccggccgcggtccgggcagcgctcagccggcgccccagcccgctcggccgcagctgcgcgcctgtagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggagcgcagaggccatggagccggagctcgcggacacctctgcactcaaggcggcgcctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggccgctgtgaaggtgaacctcacttagtggaattttcgagctggcagggtcccagacacctcatgtcacaaatcgggagagaaaccttcccaccctctgagggtctgcacgggatcccaggaggagcccagcccctcaaggatagtgggcagggatcatgggccctcagtggggactgtccactcagtggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaaggcaagtgtgcccagccccggacctgcccctgaccacacccacctgtacccacagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccaggatgtggccagcccaggtccccactcacgccctgccgtcgccttgttgcagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagccc

SEQ ID NO: 465375 - DNA, 1478 bp, Homo sapiens
atatccttccctggtccctggctctctgagtccctttttttttttttttttttttttttaaagaacaggattggaggtgctctctggggtgtcctcctaccaagctgactgttgaagtccttgtggtgctcagggaggatgggtgacactcgctgttgcttcagcttcatcttaagcccacacagcgtctccactacccaggtctcctcaggctcaggggcgagctccttctccggctcctcctcagattcatctgaccactccttcttccttttccagccaagggacctacatggggggctgggatctaccccaggggctgagtaaagaaaccaggccactgtgtaatgcttctgcatctgatcaccttagaccccgacccaaaaccccaaaccactctccatcctccccagcctcgcagactgctggcttctctaagccatctggggtaccccgaggtgctccgctggggactctgctcattctgggggtgcagttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacatgcccatttcagagtccaggctggtgggagagggaacagagtgggaaagaaaactagggtaagcagaaacgatgaaaccttataagagtgagattatcatgtacaagaagtgagattatcatgtacaagagatcccaggaatactgacttgatgaaaaagtcacatcagagcactcagtttggcagagcttttctgccgaatgtttactcacattcactgtcccagattctatactgggggtacacacgtcctctgccctaaggcaattttgagtccaagagacattttgaggcctaaaaatcataggaaactgcccctgagctcacacatatttccaatggtgtccccaatttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagact

SEQ ID NO: 465376 - DNA, 1269 bp, Homo sapiens
ttattttgctggggtcactcatgcagcaacagtcagctgtcgggtcgctgggagtgacttcactgggacagctggcaggactaggcctccctctccatgtggccttttatcctgggcttcttcacagtacaatggtctcaggattccaagaggacaggccgcagcatacaggggcttatcaaacctctgcttttgtcacacttgctgatgtcctattggccaaagcacacttgctgatgtcccattggccagagtcagtgtgggagggaatgacccaagggcgtggataccggaaggtgtggttcactgggcactgtcaccatagcaacctaccctgttccctggatcccgagaacaaggcccagggggcccaactcacacacacccagagatggcacctgaatcctacacaccacaaggcttcaggaccagtttccaagtgagaagagtgtcgtgtccccagttcctcaggagctggaagtgacagggacagcaaagaaggcagccacgtggagcctctctcactcacagaggtggagccaggcccctgctccagcccccactcagagctgggacactgagcctttggtgcccaagcccatagatacacagtgactccacatcctaccacgaatcctgtacattcactgaggtcctggatggcaagtgaccagcacaaagcttagcacacagcaagtgctcggctaaagtcactccctctccacctttccacctgggatcccctgctccctggcctggtggctgctgcactcccctgctgtccagggctgcaaagcctcagcgtcctggctatgcactttctacacgtgtgaccttcaacaaggtacttagcctttccgtgcctctgtctcctcatctataaaacaggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagagtgagtgaggccttcccagaggaaggcgcgtctgtgtgtctgtctgttaccccatccaagccacctgctgaccccagcttccctttagacttcccaccaaaagaagggcttccccctctctttctgtctgtctgtctgtcctcccaagccaccagctatcccccagcccccctccaaccatgcttcctaccaaggaagaccccagggctgtcc

SEQ ID NO: 465377 - DNA, 1092 bp, Homo sapiens
ttattttgctggggtcactcatgcagcaacagtcagctgtcgggtcgctgggagtgacttcactgggacagctggcaggactaggcctccctctccatgtggccttttatcctgggcttcttcacagtacaatggtctcaggattccaagaggacaggccgcagcatacaggggcttatcaaacctctgcttttgtcacacttgctgatgtcctattggccaaagcacacttgctgatgtcccattggccagagtcagtgtgggagggaatgacccaagggcgtggataccggaaggtgtggttcactgggcactgtcaccatagcaacctaccctgttccctggatcccgagaacaaggcccagggggcccaactcacacacacccagagatggcacctgaatcctacacaccacaaggcttcaggaccagtttccaagtgagaagagtgtcgtgtccccagttcctcaggagctggaagtgacagggacagcaaagaaggcagccacgtggagcctctctcactcacagaggtggagccaggcccctgctccagcccccactcagagctgggacactgagcctttggtgcccaagcccatagatacacagtgactccacatcctaccacgaatcctgtacattcactgaggtcctggatggcaagtgaccagcacaaagcttagcacacagcaagtgctcggctaaagtcactccctctccacctttccacctgggatcccctgctccctggcctggtggctgctgcactcccctgctgtccagggctgcaaagcctcagcgtcctggctatgcactttctacacgtgtgaccttcaacaaggtacttagcctttccgtgcctctgtctcctcatctataaaacaggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagaagatgtaccagttcagcatccaggagtcagccccca

SEQ ID NO: 465378 - DNA, 1541 bp, Homo sapiens
  misc_feature (27)..(27): n is a, c, g, or t
cagtgggtgtgacctggaagaaatccncctattccaatctcatgagagaagagcccctagttctcaggactttaaccctcttcctgccagcacccccaggccagtgctgaggctgacaagttgtctaaaagggcaggaggacttactcctgacatgcatctgccacccaaaccatcacaatagccttccgccttctcagtgggagtacgagtgaccctgcagcagaaggcagcaggaggtggtgacaagaatacacgtctggccctaaaacctgggtcagtcacatcctggctgccattcaccagctatatgattttaggaaagtggattcacctctgagctgcagattcctcatcaataaaatgaagacaagaacacccacccttagtatttgggtatttagactgtttccatgttttttttatttcttttatcatattcttggcattacgagtttagcattcaaggttctgaccaataagtgatcccaggggtgttcatgaaaatccccggggaaagcttttacaaaataaagaacggagtctattgagctggaattttctccctccatgattctgaggtctccccagccatgcggaacccactacatttcctcgcctgccttgcatctggggttagctatatgagaagttctcatcaagggaagacccctgatcctggactttcccttcttcaaacaccagcccctactcactgtggacaatacaccctagagcagtggtttccaacccctaggcccatggacctccaccgatcagcggcagtatcagattctcataggagcacgaaccctattgtgaactgctcatgtgagggatctgggttgcactctccttataagaatctaatgcctgatgatcagaggtggaacagttccattcctaaaccatccttctcccgtaccaccggtccgtgggaaaattgtcttccacaaaaccggtccctggtgcctaaaaggatcgacctgagagctgagcattttcactgtgtcttcaagccctgtacagatggcagggtgcatgtccagccatccctggcagccccagaagctgctaatagttctccagggccttctcatttgtcctgattcttttgcatggcctcccttcagatgtagtgcctccttcccccataccacacacatattgcgtggagctgaggacaccactgtccacccctggaaatggaaacataagctactgacccctttgcaagctgaccttgctgcctctttaagtgaagggtttaactgtgtccacagggtttggccagcagaccataggctggatttcaacttcattcacttcctttacacagtacacaacctatacaactgtacatggtcgacttggctttgagctcctaaatctggctcttggggtcctccctctggcttgcccctccagctgtatccaggccctttctgccatgccctggattctccaccaatagacagcttcatggggagccctgtgtatagcaggctacttcaaaccaccctgtctttgctcttactgtgt

SEQ ID NO: 465379 - DNA, 380 bp, Homo sapiens
  misc_feature (27)..(27): n is a, c, g, or t
cagtgggtgtgacctggaagaaatccncctattccaatctcatgagagaagagcccctagttctcaggactttaaccctcttcctgccagcacccccaggccagtgctgaggctgacaagttgtctaaaagggcaggaggacttactcctgacatgcatctgccacccaaaccatcacaatagccttccgccttctcagtgggagtacgagtgaccctgcagcagaaggcagcaggaggtggtgacaagaatacacgtctggccctaaaacctgggtcagtcacatcctggctgccattcaccagctatatgattttaggaaagtggattcacctctgagctgcagattcctcatcaataaaatgaagacaagaacaccc

SEQ ID NO: 465380 - DNA, 2850 bp, Homo sapiens
gaaaacgatcctgtcaccatcggatatgtttttaaatgaggtcttggttgaattctgtctatgtgaggaaattggaatggaatatggagcctgttactgtcgtttcatctcttcttcttctcttgcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactccttcgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagttcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctggcccacaagagcgtatgcaaatctctaagtttacgggactctcaatgaccactatcagtcactggctggccaacgtcaagtaccagcttaggaaaacgggcgggacaaaatttctgaaaaacatggacaa

SEQ ID NO: 465381 - DNA, 1726 bp, Homo sapiens
ggaatgagcagaggtggcactaggagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcaggtagccgcctgggggtggcatctgtgccacgggtagttgtgtcccaagacaaaatcatttcttgatttaaaacacagtgccctttgtgttggctacttcatattaaaataatacttgggaagtaagacaaataacctgttgtgcatacttagtatcagaacatttgcctcaaacgtttattttgaaattttcagattcttagttataaattttaagaaataaataccccagctgaacagattatcctttgagatccttttaattgtcatagaaggttcacacttgcacacatacatacaaaattttttgttctatcaaatgacttgttttatttgtaataacattacattttaaagtatttagccttcttttccttgctttccagaaatagcttcatgtgctaaatagctgtgacttggtttagattttacaaatatgacagtatcttggattgaactgaaagaagcaagaaaccgtcatctgtgtttcttgcgggaaagcacattaaagcagcgggaagaaggggagtgggcgcacagcctccctggctgggccctagtgaccgacttctcccgagtcagctttgctcccaaggccaggggggctgccgtcccccagaggctgctgaggagagccctcggagatgcagtgcagaagcctctccctgacgctgctgatttgggggatcctggagcactgagcatgctggtgctgttgccggaagaacggagagaaccccggaggcacggctgcagcagctctaacctagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagc

SEQ ID NO: 465382 - DNA, 374 bp, Homo sapiens
aagctcaggcttgaaactctgaatgtatttcctttgttgtcaccaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcaggtagccgcctgggggtggcatctgtgccacgggtagttgtgtcccaagacaaaatcatttcttgatttaaaacacagtgccctttgtgttggctacttcatattaaaataatacttgggaagtaagacaaataacctgt

SEQ ID NO: 465383 - DNA, 2930 bp, Homo sapiens
cctcctctcatgccagagcaccatgtggcaccccgaccgtggttcctggcacaggaacgagcaggagggtaaggacggctaccgtggaaccaacttggaaagggatggaggcctgcacttcctgtgtagtgtaattaatcgctgccccttccctgcctgcagccgtccaggctcagggccggccctgattaaccatttcctgcccaacgttgtgaaggctacgaaagacctgtgtgagctttcgcatccttccttcctacaaatgctggcctcaccccaggggcggggcatcagatgcctcacagtcccagcccgagggggaggccgaaagtcacatgctgcccctgaggtctgggacggcctctccttccccctcagccgaactcagtgccctggggaacccatttttcctgactcagctccagtaccacctcctttgtgaagctgcctagtctttttctgttgctgtaactgcatacctgagactaggtaatttataaagctaaaaaaaaaaattatttctgacagttctggaggctgggaagtccaaggtctaggagcacatttggtgagggccttcttgctgatggggcctctctgcagagtcctgaggcgacccagggcatcacatggagaggggcctcatcagagagagccaatttggccttttgtaacagactggctcttgcgataactgacctactcctgtgatgaccattagtccattcatgagggcagagcgctcaccacccaatcagctctcaaaggccacacctcacagtgctgttatattggggcatgaatttcaacatgagttttgaggagacaaacattggaatggtagcagaagagatgatgcccccaggcagtcacccactctctcctcctttccctcacagcatttttgggtaaaattgccgccgccggacacctcaaccaagcctgaactgcagcttgaagagctggatgcaggtggagatttggggataacaccacacaaagcaatgatgtaggaggtgtatgaagacggagtagttcaggacactcctttttaaaaaattggatatgagttctggcttgcctgcgcgctaggtgtgaatttgaagtctgggtttgcatccccatctgtaaaatagcatgtttcccatctttcaaacgacgatatccacaggcttcttatgtgggtcaaatgagatcaggtaatttgcaaactatgaggtactatacacacgtgggtgcgattgttggggcttatcttttggcccaagctgtgtcctagagcttccttctgactagaggaacagacactgaagcacaaacggatggctgactcttccgagcgggtcatgtgcagtctccgtgtgagctgccagccatcaagttccgatccagcctgatagagtcatcttccaactagattcttcctggatgcctttgcatggctcgtgtccaactggaaagctggcagtggatgctcgctcttccctcttcactgagcccgcttttccatactggaagaagatgaaacacacatttcagaatgtaagtttttcctgccggacactatcccccctggagtgatggagaaaaatattagatgaagtcaggggataactgagtaacatactgatttataaactcatggaatcaaatgaaagtgttttttccactggtggggttatttattatgtcctggctggacagatcccagagaggaagaggctttggtccctgagcaatagaagtagcaggaaccaattttctccattgctctgctttaaaaaaaaaaaaaaatagaactcacctggctttgaaattcatcccactcatcacctttggagtgagtggggactaaggcacaggccccatcatgctgggatgttggcaaagaagagatgaggctgctgctactggtcattgctctgtggagcttttcatgtggcctgtttcttggtggaaataaactacctggaaagtatattatgaaaaactctgatgggattttgattgtaattttactgtttatattaatttgtggaaaagtgtcatctttgtgatataaagtttttccatccatgaacatggtgtatctttccgtttattcgatttcttttttgtgtgtttcaaagaaaccttttaagtttctgtgtaaaggctttgggcatcttatgttcaattaatttctagataaattataagctttttcatgctattgtaatggaatctttaaaaatacattttgttattgttgctgttatgtaggtaaatatttgtgtgtgtgtgtgtgtgtgtgtgtgtgtgtgtgttgatagaaattgactgaagccttatcagttctaatggtttgtttattgttttggattttctgtgtaaacaatgatattgaataatgcacatttcagcttttcctttttaatcctgatatattttgtttctttttgttttgttacactgtcagttagcatcttgaggtcatcctacttgtcctgacttcaagggaaattttttggcataaatgttttatttttaaataattttaaatttattttaagaacttgcaaagatagtacatagagttgccatagacccctcacccagtgtcctccattgttaacaattatagaacatggtacccatgtcaaaactaagaaaccaaaactgatgtatcaatattcactaaactctagagtttattcagatttcactagttcttccgctaatgttccttttctgccccaggatcccatctaggatatcccattctgtttagtcatcatatcttcttagtctcccctggtctatgacagtttttccttctttctttttcatgaccttgacacttttgaggcatattggttaggtattttatggaatgtttctcaattttgagtttgcctgatgtttttctcatgaatagaatgtgtttatgg

SEQ ID NO: 465384 - DNA, 2055 bp, Homo sapiens
  misc_feature (73)..(73): n is a, c, g, or t
ggtactgatatggtttggctctgtgtccccgtccaaatttcatcttggattgtaatccccatgtgtgcaggangtgacctggtgggaggtgattggttcatgggggtggttataacaccacacaaagcaatgatgtaggaggtgtatgaagacggagtagttcaggacactcctttttaaaaaattggatatgagttctggcttgcctgcgcgctaggtgtgaatttgaagtctgggtttgcatccccatctgtaaaatagcatgtttcccatctttcaaacgacgatatccacaggcttcttatgtgggtcaaatgagatcaggtaatttgcaaactatgaggtactatacacacgtgggtgcgattgttggggcttatcttttggcccaagctgtgtcctagagcttccttctgactagaggaacagacactgaagcacaaacggatggctgactcttccgagcgggtcatgtgcagtctccgtgtgagctgccagccatcaagttccgatccagcctgatagagtcatcttccaactagattcttcctggatgcctttgcatggctcgtgtccaactggaaagctggcagtggatgctcgctcttccctcttcactgagcccgcttttccatactggaagaagatgaaacacacatttcagaatgtaagtttttcctgccggacactatcccccctggagtgatggagaaaaatattagatgaagtcaggggataactgagtaacatactgatttataaactcatggaatcaaatgaaagtgttttttccactggtggggttatttattatgtcctggctggacagatcccagagaggaagaggctttggtccctgagcaatagaagtagcaggaaccaattttctccattgctctgctttaaaaaaaaaaaaaaatagaactcacctggctttgaaattcatcccactcatcacctttggagtgagtggggactaaggcacaggccccatcatgctgggatgttggcaaagaagagatgaggctgctgctactggtcattgctctgtggagcttttcatgtggcctgtttcttggtggaaataaactacctggaaagtatattatgaaaaactctgatgggattttgattgtaattttactgtttatattaatttgtggaaaagtgtcatctttgtgatataaagtttttccatccatgaacatggtgtatctttccgtttattcgatttcttttttgtgtgtttcaaagaaaccttttaagtttctgtgtaaaggctttgggcatcttatgttcaattaatttctagataaattataagctttttcatgctattgtaatggaatctttaaaaatacattttgttattgttgctgttatgtaggtaaatatttgtgtgtgtgtgtgtgtgtgtgtgtgtgtgtgtgttgatagaaattgactgaagccttatcagttctaatggtttgtttattgttttggattttctgtgtaaacaatgatattgaataatgcacatttcagcttttcctttttaatcctgatatattttgtttctttttgttttgttacactgtcagttagcatcttgaggtcatcctacttgtcctgacttcaagggaaattttttggcataaatgttttatttttaaataattttaaatttattttaagaacttgcaaagatagtacatagagttgccatagacccctcacccagtgtcctccattgttaacaattatagaacatggtacccatgtcaaaactaagaaaccaaaactgatgtatcaatattcactaaactctagagtttattcagatttcactagttcttccgctaatgttccttttctgccccaggatcccatctaggatatcccattctgtttagtcatcatatcttcttagtctcccctggtctatgacagtttttccttctttctttttcatgaccttgacacttttgaggcatattggttaggtattttatggaatgtttctcaattttgagtttgcctgatgtttttctcatgaatagaatgtgtttatgg

SEQ ID NO: 465385 - DNA, 2736 bp, Homo sapiens
  misc_feature (6)..(8): n is a, c, g, or t
  misc_feature (10)..(10): n is a, c, g, or t
  misc_feature (17)..(17): n is a, c, g, or t
ggccannnantgtccangtgggtgcccatgagagcgctggggtcagccgagtttagggaaaaggtagatgcacagaaggagccagctccagcaccgcccaatgctgagggtgccggccctggtccctgcacatccgcgtccaggcagtgcattcctgggccaggagagggtctgcggagctgatgcaggcgatgggcagtggagtggtgccgcagcacggtgcagggagcaccaaggcttagctaccagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagctcgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagagttagtaatggagattatttttcctctctcctaaaagtcttgtacccacataaatgctttgagagtgtttgagtgtggggaggagcaagcaaacgaaaacactggtagattgaggagagacatgtaccgctgacccctgaacagtgtggggcctaggggtgctcacccccatgcaatcagagatctgtacatcacttttgattcccgaaaacccaaattactaatagcctggtgttaaccagaagccttactgataaacaggcaattaacgcatattttgtatatgtattaccatattcttacaataaattctggtcttgaaagttttaggaatgatattaccaaatgtgttccataatgccaaagaaatagtgaaaaaatatgtatcaactaagaagtagaagaaatagtacttggttttggttttttgcttattttgtgtttaccttattttctctttttttcttagattatttctgtgactggatttgttgatagtgacagagatgacctaaaattaatggcttatttggcaggtgccaaatatacgggttatctatgccgcagcaacacagtcctcatctgtaaagagtaagcaaattttcgaaactgtttttaatcataaatttacacacaatatagtggctatttcaataattgtgccttttttagtatgtcatagttttgtggtagaaatttgtggaaatcaaagtctgttaaagtatgacaatgatatagtaatgttagtagaaatacctagaaaacatttgaattaatgaaattagatgaactaatgaaatttgaatgaacaaaacaggaatagggtagaagtaagactccttagtggttttgtaattctgtgtgagccttgaggtgtatatttcattaccattcagggtcaccctcaactttgctaggatatgcctcccacttctattatgagaaattttttattgccttttgttggaaataaatgtacatttggacagttgacatctctaacatttaataaatatgttttctcctcaaaaaataaaaagaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttaggccagttaatcttttgtccaaattgctccctaccctacagaacattccctgctttcctagaattgacgtctgtcctctttgtcactattgagctttgactgacttgctgttacatcttggatgccatcatggctcctgtgataaggcaagaagaacacaaactgaactgttgacttttgtaataaaatcctaattatgtgatttttttgaggctgtcatcaaattaccacaaatacattttaaaataaatttttattggactgtctcagaaaataataacctgaaaaaaagacctaaaaaattcatgtaaaaaacaaaaaggtttaatttaaaacgtgtgcttgagcagagccacgtttttataatttgtggttgaagagggctagaatgtgaaagacactggaagctctagcgacactcgtcttggctgacttgtattgatggtgaacgtgcaaacaaggaatggcctgagtcacacaaggttatcttaaaaacttgatagaaaaaaatgaagtgatagagctagcaaaatcagtgatgtttagaagcaactttgatatttgctttcttctgaaagccaattaaaaaaattaa

SEQ ID NO: 465386 - DNA, 1141 bp, Homo sapiens
gtaccaaagaactaagtaaatcaataaagataatcggttctttaaccttcttaaggagtcaacaggaattagaaattatttgcagtttcagacagaatagtattttgtggtatcctcaggagcaatcttgttagataattaaatcttaagcatcaatatcatttcctgctctgagttcaaataatatggagaaaataaagaaaagggatataagccaggcagcatgctatgccagagctgttgctgggcagataagtgtggtgaaatataatgctgatttaaaattgtatagaaattgtgaaaaatatttgtaatattcttgcttattcacaaaacactttgttttagggacttaagttctggttactttaaatcatcttcaggcatacttaacatgtgaaaatgcttacattccaaatttacatagctggattcctcttccacttcagattgagtgctagtaggagaatagtaccttcataatgtcataaaatttgaaattttgtcaaaaatctcagggcagaatctatgagaattatgtactctaaaaattaaagcattttaagaacataatacatatattttcatttaattttaggcaaaatatttttacatcacacctggaatctgcccaagtctttccactatgaaggcaatcgtagagtgtgcaggaggaaaggtgttatccaagcagccatctttccggaagctcatggagcacaagcagaactcggtgggtagagtggagtccgccagcgagtccgtcattgccctgtatcacattcagcgttcggtcactgagaaactcattttcttttccttagagtttgtcggaaataattttaatatcctgtgaaaatgaccttcatttatgccgagaatattttgccagaggcataggtacgtttccccgcttacctgtgtgagtatgtgtgcacgcacagcagtggatctctaactaaagtgtctgtttccaccctgttcagatgttcacaatgcagagttcgttctgactggagtgctcactcaaacgctggactatgaatccttgggggccttttttcatatccatagcttgatgaattttgcccaaagtggacggtttagaattgcagaggtcactacctgctcctgcaggtat

SEQ ID NO: 465387 - DNA, 3303 bp, Homo sapiens
tgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagctcgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465388 - DNA, 3260 bp, Homo sapiens
tgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaataagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagctcgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465389 - DNA, 3892 bp, Homo sapiens
tgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagctcgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagagttagtaatggagattatttttcctctctcctaaaagtcttgtacccacataaatgctttgagagtgtttgagtgtggggaggagcaagcaaacgaaaacactggtagattgaggagagacatgtaccgctgacccctgaacagtgtggggcctaggggtgctcacccccatgcaatcagagatctgtacatcacttttgattcccgaaaacccaaattactaatagcctggtgttaaccagaagccttactgataaacaggcaattaacgcatattttgtatatgtattaccatattcttacaataaattctggtcttgaaagttttaggaatgatattaccaaatgtgttccataatgccaaagaaatagtgaaaaaatatgtatcaactaagaagtagaagaaatagtacttggttttggttttttgcttattttgtgtttaccttattttctctttttttcttagattatttctgtgactggatttgttgatagtgacagagatgacctaaaattaatggcttatttggcaggtgccaaatatacgggttatctatgccgcagcaacacagtcctcatctgtaaagagtaagcaaattttcgaaactgtttttaatcataaatttacacacaatatagtggctatttcaataattgtgccttttttagtatgtcatagttttgtggtagaaatttgtggaaatcaaagtctgttaaagtatgacaatgatatagtaatgttagtagaaatacctagaaaacatttgaattaatgaaattagatgaactaatgaaatttgaatgaacaaaacaggaatagggtagaagtaagactccttagtggttttgtaattctgtgtgagccttgaggtgtatatttcattaccattcagggtcaccctcaactttgctaggatatgcctcccacttctattatgagaaattttttattgccttttgttggaaataaatgtacatttggacagttgacatctctaacatttaataaatatgttttctcctcaaaaaataaaaagaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465390 - DNA, 3150 bp, Homo sapiens
tgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagctcgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaat

SEQ ID NO: 465391 - DNA, 1360 bp, Homo sapiens
gtaccaaagaactaagtaaatcaataaagataatcggttctttaaccttcttaaggagtcaacaggaattagaaattatttgcagtttcagacagaatagtattttgtggtatcctcaggagcaatcttgttagataattaaatcttaagcatcaatatcatttcctgctctgagttcaaataatatggagaaaataaagaaaagggatataagccaggcagcatgctatgccagagctgttgctgggcagataagtgtggtgaaatataatgctgatttaaaattgtatagaaattgtgaaaaatatttgtaatattcttgcttattcacaaaacactttgttttagggacttaagttctggttactttaaatcatcttcaggcatacttaacatgtgaaaatgcttacattccaaatttacatagctggattcctcttccacttcagattgagtgctagtaggagaatagtaccttcataatgtcataaaatttgaaattttgtcaaaaatctcagggcagaatctatgagaattatgtactctaaaaattaaagcattttaagaacataatacatatattttcatttaattttaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465392 - DNA, 1451 bp, Homo sapiens
gtaccaaagaactaagtaaatcaataaagataatcggttctttaaccttcttaaggagtcaacaggaattagaaattatttgcagtttcagacagaatagtattttgtggtatcctcaggagcaatcttgttagataattaaatcttaagcatcaatatcatttcctgctctgagttcaaataatatggagaaaataaagaaaagggatataagccaggcagcatgctatgccagagctgttgctgggcagataagtgtggtgaaatataatgctgatttaaaattgtatagaaattgtgaaaaatatttgtaatattcttgcttattcacaaaacactttgttttagggacttaagttctggttactttaaatcatcttcaggcatacttaacatgtgaaaatgcttacattccaaatttacatagctggattcctcttccacttcagattgagtgctagtaggagaatagtaccttcataatgtcataaaatttgaaattttgtcaaaaatctcagggcagaatctatgagaattatgtactctaaaaattaaagcattttaagaacataatacatatattttcatttaattttaggcaaaatatttttacatcacacctggaatctgcccaagtctttccactatgaaggcaatcgtagagtgtgcaggaggaaaggtgttatccaagcagccatctttccggaagctcatggagcacaagcagaactcggtgggtagagtggagtccgccagcgagtccgtcattgccctgtatcacattcagcgttcggtcactgagaaactcattttcttttccttagagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465393 - DNA, 1537 bp, Homo sapiens
gtaccaaagaactaagtaaatcaataaagataatcggttctttaaccttcttaaggagtcaacaggaattagaaattatttgcagtttcagacagaatagtattttgtggtatcctcaggagcaatcttgttagataattaaatcttaagcatcaatatcatttcctgctctgagttcaaataatatggagaaaataaagaaaagggatataagccaggcagcatgctatgccagagctgttgctgggcagataagtgtggtgaaatataatgctgatttaaaattgtatagaaattgtgaaaaatatttgtaatattcttgcttattcacaaaacactttgttttagggacttaagttctggttactttaaatcatcttcaggcatacttaacatgtgaaaatgcttacattccaaatttacatagctggattcctcttccacttcagattgagtgctagtaggagaatagtaccttcataatgtcataaaatttgaaattttgtcaaaaatctcagggcagaatctatgagaattatgtactctaaaaattaaagcattttaagaacataatacatatattttcatttaattttaggcaaaatatttttacatcacacctggaatctgcccaagtctttccactatgaaggcaatcgtagagtgtgcaggaggaaaggtgttatccaagcagccatctttccggaagctcatggagcacaagcagaactcggtgggtagagtggagtccgccagcgagtccgtcattgccctgtatcacattcagcgttcggtcactgagaaactcattttcttttccttagagtttgtcggaaataattttaatatcctgtgaaaatgaccttcatttatgccgagaatattttgccagaggcataggtacgtttccccgcttacctgtgtgagtatgtgtgcacgcacagcagtggatctctaactaaagtgtctgtttccaccctgttcagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465394 - DNA, 439 bp, Homo sapiens
gcaataagagaaagaaagagatgtgttactgcacactggttaaacacagtcttaaagaagaagaaaatggtaccgccgcaccgagcccttcacttcccagtggccttcccaccaggaggaaagccatgttcacagcatgtaagacagagtcctcgcgttccatttgttaaatcatccttcgactttggcgaataatcacttgctagtgcttacctgaggctcctgcgttggcttctgagtcagagcttctctatgtacttttgcccagttcataagtgcctgctcataagaaatagtgtgttttcttttagttctgtgtaacagtcacaattttctgcacatagtagatatttaatggattctccagtctttgacactatttaaaatccaaaaataaatcagatgtcttgcaccaaaggcggcccctgttgggttaact

SEQ ID NO: 465395 - DNA, 2931 bp, Homo sapiens
tgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465396 - DNA, 2452 bp, Homo sapiens
  misc_feature (8)..(8): n is a, c, g, or t
gcagcagnccagttttgaatgtacggtccccggcaggtgaggcagggcaggaggcaggagtagcaggaggggggggagccaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagctcgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465397 - DNA, 3480 bp, Homo sapiens
tgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagctcgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcggtgggtagagtggagtccgccagcgagtccgtcattgccctgtatcacattcagcgttcggtcactgagaaactcattttcttttccttagagtttgtcggaaataattttaatatcctgtgaaaatgaccttcatttatgccgagaatattttgccagaggcataggtacgtttccccgcttacctgtgtgagtatgtgtgcacgcacagcagtggatctctaactaaagtgtctgtttccaccctgttcagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttaaaaattgagtaatcc

SEQ ID NO: 465398 - DNA, 945 bp, Homo sapiens
ggggacacattcaatccatagcaggtgttatccaatcagtacaatgaagtgtgatcaggtgatgacaggggatgggggtacagagacagctgcccagaaaggggggccccaggacccccagagtaaagaagctagattcccacggtacctaccaggattcagcaaggaaagcaggaaaagtatcacagcagatgtaaggggcagggacaaagaaggccatgatgactctgctggagatccccaggatggcatcacagagggagggatgccagaactgagatttggatacacagctcaggaggcaggtcaaggtattccaggcagaggcaccacttgtgcaaaagcagaggggcaagcaagtcttaacccctatcagtatcattcactgctcctcatggatgccatagtcagcctgagtgtcctcgctcgtaaaatgggtctaacaacgaccacctccaagaaagatcacgatgctgaaatgactcagaacagtgcctggagtggaagagctgctgggaaaataataactgctatttctacatcagttatgccagttctttttgacctaagaaactccagcgcttttaatacaatcaaactgggttattggtgacttacagaggagaccctaggcaggtgtgacattcttaaccctgtctttaatacaactgccacatcccagcgttccttgacagactgtggagcacacctaagccaccttgcttgccatagggtttggctccatgaccttgatgtgagttcatagatttgtttgcagttgtgaaaattaaatgagagagcgagatttcattgtgtgtgtggagtgtgtgtgtgtgtgttgggggagggaggagaacaaacgattttaaattcagcctaaaattaaatgcacattggatgcatgccaaacggactccacaaccaccagactttgcaagtttcaac

SEQ ID NO: 465399 - DNA, 917 bp, Homo sapiens
ggtgcggtggcccagcgcggccgcctggccctcgagctcgccgaagatgtccccggcgcagcgcgacagggttgttatgaggctcaaaggaacggctgctgtgaaaaaacatgctttgcaatttatgaagcactggataaacatcaggaacggtataaaagcatgctgcttactcaagaaatactagttgagtgcctgtgtgttgggcactggctagagataagggtctcctatggacagaagtgcgggcaaggagctttgttcctccccgatgtcaccctcccacagcccacttgctagcaggcgagagaggggtggaggccggcagtaaggcatgtactgaactggacctctggtggaatggcgtcacccacgctgggcttggtgggtatttgaaagtgactctttcgtgaacactgttgtgagccctcactgggaatgtctggccatgcttcctgacgctggcaatgaattttctctagctgcttattctaccccaaccttggtcttccttctgtcccctccatgcagactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttc

SEQ ID NO: 465400 - DNA, 498 bp, Homo sapiens
cacactgaaagtttctctgctttgggccagcaggaaattccagttgcttcattcaccggagccagttaagctgctgaaatgaaatggatcaccggagagatcactatatcaggacatagacttgactttcagggttggaggaagccggacaaagatgaatgggattcagagcctgaactcaaggtcaacgtcttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttc

SEQ ID NO: 465401 - DNA, 729 bp, Homo sapiens
agcaagggtctgagaaagaggtcttccaggttgttatgaggctcaaaggaacggctgctgtgaaaaaacatgctttgcaatttatgaagcactggataaacatcaggaacggtataaaagcatgctgcttactcaagaaatactagttgagtgcctgtgtgttgggcactggctagagataagggtctcctatggacagaagtgcgggcaaggagctttgttcctccccgatgtcaccctcccacagcccacttgctagcaggcgagagaggggtggaggccggcagtaaggcatgtactgaactggacctctggtggaatggcgtcacccacgctgggcttgactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttc

SEQ ID NO: 465402 - DNA, 468 bp, Homo sapiens
cagctcggtaccagatttcacggcagtaaggcatgtactgaactggacctctggtggaatggcgtcacccacgctgggcttgactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttc

SEQ ID NO: 465403 - DNA, 1851 bp, Homo sapiens
cacactgaaagtttctctgctttgggccagcaggaaattccagttgcttcattcaccggagccagttaagctgctgaaatgaaatggatcaccggagagatcactatatcaggacatagacttgactttcagggttggaggaagccggacaaagatgaatgggattcagagcctgaactcaaggtcaacgtcttctgaatcacaaagagctggtgggtcagtctgggagaagaaagaaaattctgcgccaaatgggaaaacccttaaagtctgcatagttttgcttgtcggtaagaacacaggtaggcggcgggaagagaggtggcaagcagccccaacgctcgccgagatccccagggttttacaaacggatcgtcctgaagtctccaaaactgtaactactatatgcccaaatttatattctcccctggcttttccaacaggctacctgcctgtgacagttttcccacgaacttggctctcctctgtctacagcgccccggggtctcccaaacagacagacacagacagacagaaggagcagacaaggggactgtccaattcccaccctccacgcccagctaattttgtatttttagtagagatggatttcaccatgttggcccggctggtgttgaactcctgacctcaggtgatccacccacctcagcttctcaaagtgctgggattacaagcgtgagccacagcacccggcccagcattgttctttagtttattccctcttctattcccttgagactttcccattggtttgaaaagaattatgatttagccacataaactaataaaaagagagcaagaatatttttgtaaatttgtaatcctggggcaatatcaatagaattttttttataaaatgaatgatttcactactccagaagtggaatgtaaactctatacataaccagaacatggaattaacaggactcatgggtgtatccataaaagcaactgaatttttagtcttctgctgttaataatctgttccatgaggatagttcttcctcttccacagaatgaaactcaggcagtcctataacttttttattctctcaggtaatagaaaatcctgttactttaagaggaaaaaccctgctcttaattcagtaattcaaatcttgtccccttccccaacagggtctcctatggacagaagtgcgggcaaggagctttgttcctccccgatgtcaccctcccacagcccacttgctagcaggcgagagaggggtggaggccggcagtaaggcatgtactgaactggacctctggtggaatggcgtcacccacgctgggcttggtgggtatttgaaagtgactctttcgtgaacactgttgtgagccctcactgggaatgtctggccatgcttcctgacgctggcaatgaattttctctagctgcttattctaccccaaccttggtcttccttctgtcccctccatgcagactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttc

SEQ ID NO: 465404 - DNA, 360 bp, Homo sapiens
cccccgactagcccgacagtccccgactagcccgacagtgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttc

SEQ ID NO: 465405 - DNA, 1610 bp, Homo sapiens
ctgttgtacagcgcctcattttttacaatgtgggccagtaactatttcgtatcacctactctgaccaccttcagggttgttatgaggctcaaaggaacggctgctgtgaaaaaacatgctttgcaatttatgaagcactggataaacatcaggaacggtataaaagcatgctgcttactcaagaaatactagttgagtgcctgtgtgttgggcactggctagagataagggtctcctatggacagaagtgcgggcaaggagctttgttcctccccgatgtcaccctcccacagcccacttgctagcaggcgagagaggggtggaggccggcagtaaggcatgtactgaactggacctctggtggaatggcgtcacccacgctgggcttggtgggtatttgaaagtgactctttcgtgaacactgttgtgagccctcactgggaatgtctggccatgcttcctgacgctggcaatgaattttctctagctgcttattctaccccaaccttggtcttccttctgtcccctccatgcagactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttccatctgcagtcacttgagtcttttgtagcctgtgtgattgagcatctaagcagtcctcagctatttactttgaaatttcctccaaagcactttgcaaagccaaacttgaaccaacaaaaggtcatggtccctgtttggtggtctgctgccggtctgatccactacagctttctgaatcctggcgaaaccattacatctgaaaagtatgctcagcaaatcgatgagatgcacaaaaacctgcagcaccggcagccagcattggtcaacagaaagggcccaattcttctccacaacaacgccccactgcacatcacacaaccaacgcttcaaaacatgccagagtcctccatgcagaatgacggcctacagccttgggatagagttattgagttggttacaaatcagccgcccaaattatattcctctatcttatctataaaagtattgggatttgttgttttcgtatgtatgcttgggtgaactgtttaggaaactgtatctagttatggattactccctgaagagctgctttcacccagtagccttttgaaaactcagctggtctttgtcaactaacaatacaagaaacagtttataaatctattattttgtttgctatgaatatttacttgagaaattccttttaaaagcaataataggaatagcatttcttcctagaagaaataag

SEQ ID NO: 465406 - DNA, 1704 bp, Homo sapiens
cacactgaaagtttctctgctttgggccagcaggaaattccagttgcttcattcaccggagccagttaagctgctgaaatgaaatggatcaccggagagatcactatatcaggacatagacttgactttcagggttggaggaagccggacaaagatgaatgggattcagagcctgaactcaaggtcaacgtcttctgaatcacaaagagctggtgggtcagtctgggagaagaaagaaaattctgcgccaaatgggaaaacccttaaagtctgcatagttttgcttgtcggtaagaacacaggtaggcggcgggaagagaggtggcaagcagccccaacgctcgccgagatccccagggttttacaaacggatcgtcctgaagtctccaaaactgtaactactatatgcccaaatttatattctcccctggcttttccaacaggctacctgcctgtgacagttttcccacgaacttggctctcctctgtctacagcgccccggggtctcccaaacagacagacacagacagacagaaggagcagacaaggggactgtccaattcccaccctccacgcccagctaattttgtatttttagtagagatggatttcaccatgttggcccggctggtgttgaactcctgacctcaggtgatccacccacctcagcttctcaaagtgctgggattacaagcgtgagccacagcacccggcccagcattgttctttagtttattccctcttctattcccttgagactttcccattggtttgaaaagaattatgatttagccacataaactaataaaaagagagcaagaatatttttgtaaatttgtaatcctggggcaatatcaatagaattttttttataaaatgaatgatttcactactccagaagtggaatgtaaactctatacataaccagaacatggaattaacaggactcatgggtgtatccataaaagcaactgaatttttagtcttctgctgttaataatctgttccatgaggatagttcttcctcttccacagaatgaaactcaggcagtcctataacttttttattctctcaggtaatagaaaatcctgttactttaagaggaaaaaccctgctcttaattcagtaattcaaatcttgtccccttccccaacagggtctcctatggacagaagtgcgggcaaggagctttgttcctccccgatgtcaccctcccacagcccacttgctagcaggcgagagaggggtggaggccggcagtaaggcatgtactgaactggacctctggtggaatggcgtcacccacgctgggcttgactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttc

SEQ ID NO: 465407 - DNA, 2063 bp, Homo sapiens
accttagagagaaaatccatactggccagagaccaagttaatggaaaatttaattgaagcaaatgaaatgctcagcctcataggtagtatggccctgtgccctttgaaccagaaaggctgggccaggaggccacagagggccctaagggaaaactcccttatctgcaagaacaaggggcgggactgagtttgagaaaagaaaatctgcaaacctccacaggagcctcagtgaaaggctgcatgcaggggaggaaaccttcaggttttggtcaccaggaagtccgttagagattcacagcagaaggcccctctgcatcccacagcaccaagcacgtgctggaaaccggcggtcccccagaggacagtgggagaggctgccgggtggcagagacacaaccaccaagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacctgcactgaaactctgctaccacattgacaaactgaagcaagccaagttctgacttttttaaaaagacagaagcgaaacccaaaacaacagatcccaagattatcttctgccttaccaatatcccgccaacatcacaaactagactctcctcttaaaattaacagccacagagacgtggtctttttataaaacttgtgaatctttgccttttgaagaatttaacatggaccttttcgagaggctcctctgtgttcataatttgccaaaaaattacaaaagcctgtgatttttaacatccctgttatgctggtttctcttaaagtgggtcctatttgcataacgagagagtggggaactgaatgcttatgcccaaggagagttctggagggttcaaaggatgaaagaaggacctttgtccctgcggtctctgcagggacaaccccctcagcaccatctgcctctaactctgacctggggacctatccatgtgagccttgtttgcctcagctctggaagctgacttctgaagatgactgcctcaccttgcactgtctggaaaacttgaattattttacgccgtgaaagaaaaaggaaaaaaaaaaaaatcttttctgttcctagaaaatctgaagtactgtgtttctccgctagagggcagactgctaatgaaatttcaggaccctcactgactgcagtagcaggattgttcagtactgagtggatgggttagggtgtctgtgaacaagatctagcccacacagaaacaggggatttattccacagttagcaccacagattgcgacttgggaaaaaaccatcagctagaggggtctagttcgtatccaatcattattgactgactgactgatactcaactagcaaaggcaagaatttggaagcacgctctacccagatgggactttggagttccttcccttccagagtccttattgaggtgttgaagtgttggcatgccgaagaatcttagtgacatttagccatgggtgtttctttaaaaaaggaaaagaaaatgtctcaacgaagctttgaaatgggagagtgttgatttctagttacattgctgggttatgtagttgtatctgtggctaatttttctagtcctcaacaaatacacagacatgctatta

SEQ ID NO: 465408 - DNA, 1389 bp, Homo sapiens
ggcttttgtgacgctttccctgggctctgaaggccagggggcttggatgtgagtctagtgctcctggtccccaaagtcacaaccccttctatcccagcatcccagacttctccgggcggggacagagttggacgtgcatggctgtgtcctgcaatcccctcgccacgaccgcccgggacggagtggaagcgggtccgtgcccccgttcctcgcgccagcctcggcggtggcaagcgctgtcccccagcagaggtgtccctggatacaggccctctgcagccccaccacacttggtccccacgctgaccggctaagggtgtgttgagcccgcctgaggcccaagccttccctctgcccagagctggggactcctggccaatgggcactccagctcacagaccctcggtattaggtggctccttcatagaccacggacagagcctgggctgcagaacagaacccacacccgggcgcaaaccacaactcagggctgcttcctgggatagcgaagaaaggctttgggagtgggcggaccgagggcgcagggcgcttctcctccaggtcctcggctcggccaccccggtccggcaaatggcggaacagacccagcctgcccttcactgagcgccactggttgctggtgcccctgcctcggccacagtcgcgatctcggaaaatccagagccagaactgtagttatacagaagactccagtgctccatacccaccctgggtggcaaggcctgcagttccacaccctattttaagtctaacaccttcactttgtacttttgcctttggattctaatgtgaagaaggaaaaggccttcaatgcagaaaatggtgaaaaaaaaaatacctgccaggacattataaggagaaaccaaaaaataaactggccatggttttgcaaggtgggcaaagccaggaagaggagatcgggagagagaggtccgatgtgaagatgtgcacagagatgtctggaaaataagcccagaaaaaatagtcttcataacccatataggggaaagtggaaaaaaacttgggcagagttctaacgtggtgtgtcatcacaagacacatgccagagagaagccctaccagtgtaaagaatgtaggccaggcgcagtggcatcccagcactttgggaggtcaaggcaggtggatcacgaggtcaggagatcgaaaccaccctggctaacacggtgaaacccccgtctctactaaaaatacaaaaaaaatatccgggcatggtggcaggtgcctgtagtcctagctactcgagaggctgaggcaggagaatggcatgaacctgggaggcggagcttgcagtgagccaagatcgcaccactgcactccagcctgggtgacagagcgagactccgtctc

SEQ ID NO: 465409 - DNA, 1258 bp, Homo sapiens
caaggtgaagcctgaagttttccaaacttcaaacttgaagttaaagtgcttctatccacttccaggggttggtgcccctgtgccagacagagcaaacgggaggtagctgctcttcaacccctttctccttttcctaggccctctgcagccccaccacacttggtccccacgctgaccggctaagggtgtgttgagcccgcctgaggcccaagccttccctctgcccagagctggggactcctggccaatgggcactccagctcacagaccctcggtattaggtggctccttcatagaccacggacagagcctgggctgcagaacagaacccacacccgggcgcaaaccacaactcagggctgcttcctgggatagcgaagaaaggctttgggagtgggcggaccgagggcgcagggcgcttctcctccaggtcctcggctcggccaccccggtccggcaaatggcggaacagacccagcctgcccttcactgagcgccactggttgctggtgcccctgcctcggccacagtcgcgatctcggaaaatccagagccagaactgtagttatacagaagactccagtgctccatacccaccctgggtggcaaggcctgcagttccacaccctattttaagtctaacaccttcactttgtacttttgcctttggattctaatgtgaagaaggaaaaggccttcaatgcagaaaatggtgaaaaaaaaaatacctgccaggacattataaggagaaaccaaaaaataaactggccatggttttgcaaggtgggcaaagccaggaagaggagatcgggagagagaggtccgatgtgaagatgtgcacagagatgtctggaaaataagcccagaaaaaatagtcttcataacccatataggggaaagtggaaaaaaacttgggcagagttctaacgtggtgtgtcatcacaagacacatgccagagagaagccctaccagtgtaaagaatgtaggccaggcgcagtggcatcccagcactttgggaggtcaaggcaggtggatcacgaggtcaggagatcgaaaccaccctggctaacacggtgaaacccccgtctctactaaaaatacaaaaaaaatatccgggcatggtggcaggtgcctgtagtcctagctactcgagaggctgaggcaggagaatggcatgaacctgggaggcggagcttgcagtgagccaagatcgcaccactgcactccagcctgggtgacagagcgagactccgtctc

SEQ ID NO: 465410 - DNA, 2597 bp, Homo sapiens
ggcttttgtgacgctttccctgggctctgaaggccagggggcttggatgtgagtctagtgctcctggtccccaaagtcacaaccccttctatcccagcatcccagacttctccgggcggggacagagttggacgtgcatggctgtgtcctgcaatcccctcgccacgaccgcccgggacggagtggaagcgggtccgtgcccccgttcctcgcgccagcctcggcggtggcaagcgctgtcccccagcagaggtgtccctggatacaggatagcaaaacctgatctcataaaacctaggtcacaaaggacagccctgcaaaacagaccctatttggatcaagtgagccagttcctggaacctgaataatgactcctgaatcaagggatactacagatttgtctccagggggtacccaggagatggaaggcatcgtgatagtgaaggtggaggaggaagatgaagaagaccattttcaaaaggaaagaaacaaagtagagtcatcgccacaagttctcagtcgctctacaactatgaatgagagagccttattgtcatcgtatttagttgcatatagagtggcaaaagagaaaatggctcacacagcggctgaaaaaattatccttccagcatgtatggacatggtacggacaatttttgatgacaaatcagctgataaactaagaactatacctcttagtgataatacaatatctcgtcgaatctgtacgattgcaaaacatttggaagcaatgcttattacacggctgcagtccggtatagactttgcaatccaactcgatgagagcactgatattgcaagttgtcccacactcttggtttatgtcagatatgtgtggcaagatgattttgtagaggatctcttatgttgtttaaatttaaattcacatataactggattagatttatttactgaattagaaaactgccttcttggtcagtataaattaaactggaaacattgtaaaggaatttcaagtgatggaacagcaaatatgaccggaaaacacagcagacttactgaaaaattgttagaagcaacccacaacaatgctgtttggaatcactgttttattcatcgagaagctttggtatccaaagaaatttcaccaagtctgatggatgtattgaaaaatgcagtgaaaactgttaattttattaaaggaagctcactgaatagccgacttctcgaaatattttgttcagagattggagtgaaccacacccacttattgtttcatacagaagttcgttggctttctcaaggaaaagtattgagcagagtatatgaactcaggaacgagatttacatttttctcgttgaaaagcaatctcatttggcaaatatttttgaagacgacatttgggtaacaaaattggcatatttaagtgatatttttggcattcttaatgaattaagcctgaaaatgcaggggaaaaacaatgatatatttcagtatcttgaacatattctaggattccaaaagacgttattattgtggcaagcaagacttaaaagtaaccgccctagctactatatgtttccaacattattgcaacacatcgaagagaacattattaatgaagactgcttaaaagaaataaaattagagatattgttgcatctcacttctttgtctcaaacttttaattattactttccggaagagaaatttgaatcattaaaggaaaatatttggatgaaagatccatttgcttttcaaaacccagaatcaataattgagttaaacttggagcctgaagaagagaatgaattattgcagctcagttcatcattcacactaaagaattattataagatattaagtttatcagcattttggattaagattaaagatgactttccactgctaagtaggaagagtatattgctgttactaccattcacaactacatatttgtgtgaactaggattttcaatcttgacacggttaaaaacaaagaagagaaataggctcaatagtgcaccagatatgcgggtagcattatcttcatgtgttcctgactggaaggaacttatgaacagacaagcacacccatcacattaaatacaaactttacaaaattctgtgtatagccaggtgtggtggcttacgcctgtaatcccagcagtgggagaccgaggtgggcagatcacttgagttcaagaccagcctggccaacatggtgaaaccccatctctactaaaaatagaaaccttagccaggcgtggtggcacatgcctgcagtcccagttacttgggtgcctgaggcaggagaatctcttaaaccaggaaggcagagattgcagtgagctgagataatcccactgcattccagcctgggcaacagcgtgagacttcatctcaaaaaaaaaaaattgtatttgtacttttaaagggattttgcagtatgttgtagttaaacgttaataaaattatatttgtaattaggattttatttttctacatagtatgtttcatgaaactcatttcagttacatgaatgtgtgtatgtgtacaaggttattatataaaatatatgtcctgtgaattattgtcaagaattttgaaaact

SEQ ID NO: 465411 - DNA, 2009 bp, Homo sapiens
ccgtgggacttcaggatagaagtttctagaggcagtaacgggctattgaaattgtttatgtgggtgtcacccgtttaaatgtacactttagaaatttcactctggcaacaactgaaatacagttggaagtgggaaaaactggagatgatcacactgacatgttcctcactagacccaaggatggctcaggggaagctgcgtatggaaataggaacaaagctcagatgccttatctggacagtccacaagggtgtgcactgggtaaccttctggtgggtggagaggagccagactgggaatctggaggtcagaaggctttggcttggcctcctcacacatctacactcgggtgtgaactgtgagtttgccctcctagatcactctgcagatagatatattaagaatgcacctcctgtccctcgggcaccaagtgagttgtctttgaagactcgacttaaatgttcacctcagttaaatctccgtagacctccatgaagatatgaaacccttttcccttccatttgacaattcaaagaaaaaagagctaaataaaaagaaaattccgaagttgtgagtatgaattttaatagtacaagtgtatatattttaaatgatcagtataaatttaaaagaaacagcttaatgaaatacaagtcagtttatttgatattcagcctacagctttccaaagcagcagttgaacatgttgttgagtttataccattcattcattcatttattttttctttctttctttcagaaaatactgggtgtttgatatttgtttcactgtgctagtttctgggaatgtgtaaggaagaggctggctgtgtggatgagagcaacttgctttttacaataattatttgttattgtaaattaacaatttgctcttctggtattatatggaagtatttgatcctgttgatggcactgcctttgcttttgcaagattaaaatgaaatgaagtttctgagatgttaactctattcttgacctcaaacatgacaccaagatgactggatacaagaagaaaattaatgtcacctcaggaagtatctcccccatactccatcaagagcacttacgtggccataagcactggccacatccccatgcacctgggaacaatccatttattttctaaaactttaaaactttctacaaacctgatttttcaatttttgatatgtttcttaaagtattttatcaagattttttatttatttccaaatactggcttggatttttttctcatctgaacactgagaaattccaggaaaaaaaactatatttggtacttcgtgtcttcaaattttgatgcaatgactttataaattagcctatactgatagtgtaaaactgagttaaaaaaggaaaaaacttaggcccgtgtggaatatttaccaatgcttactttaaggtataaaaatgattttgttttcattcactctgaactaatgctatgaattagaagtttttctattcatcaaacattattgcaagggtttactgaatttgttcacttatttatattttcaatacatgtttactgaacacaatgtatgtgcaagacttggagatacaccaaaaataagaaacacaaaatccctgcccttgggtagcttatttttagaaagttgttttagtttttatttcttgttgccttattatttatttactttttatattatatattatattatttaatgataatatattatatattatattatttaatgataatatattatatattatattatttaatgataatatattatatattatatataatataattatttatttattcattatatataatataatatataatatattatttatttatttatttatttatttttatttattttttagcctttctatttaagataagaacagtttacaccccatagctacagtattgtagtattctaaatttttctgtgtgcttactattagcagtgaattttgtaccttcagatgatttcttattgctcatt

SEQ ID NO: 465412 - DNA, 1691 bp, Homo sapiens
cattcacctccattggagactgggaataaacttgtaaatagacaattgcattgtgatgtgccaagcccaacattccattttatagtcccatggaccgagaagctgagaaggctgtcgtctcatctatagagagcattactagatccaagttggggaatcatggcagggactggagccctgcgttctacctttgctgttacttagctgtgtgacccttagcaagtcactggccaggtctggatcacagttttctcatctgtacatgaaaaggttttcagcttctcgtgagtgactgggaaccacacttaccctatgtccacacaaccacctggagccgagtagaggtggctcctgctaaaaatgacatctcatgtctgtccaggtcctggtcctccattccactcaggggcagggcctttcttcatgtcctggttgacccagaggccccgagtctgtggtctgggttcccctgtttccttaggctgagccagttgtagccacagaactcaattctcctccacacccgaagctgctcggaaatgtccttccagcattacctgcaccaatggtaataggcagctatgctcactgggaaagaaaatctgaacaagacaaatggaacctctcctgaggcaaatctaccccagtgggttgaagatggaattgtaatttggagacagaagaaaagaaaaaaataataaacagcagcacgattcccattttctctgaattctgacattgttgagtgccaactggacaggcgcctcacgcgcatcccatctatgccacacaatcatcccagtgaggtgggtgtcatggttcctgttttatggatgagaaaagtgaggctcagagaggttgagtaacttgtacaaagtcacatacttaggaagtggcaaaggcaggctaaccccacccttgattgtgaactggattgggtgaaagttcttgcagggtgggccagggtgaaggccgccctggtggaactcctgaggcaatgagcgatcctgctgatgcctgtaaatggtgccagcagcgcaggagattcctgccctgggagaagagggggaatccaagggaagcatgtgggagtgctactggcatctggtgggtagaggccagggacactgctaaacatcctacaacgaacaggacagcccacaacaaacactggggacagtctagggcagtggttctcagcatcgagcagcatcagaacaccccagaaggaagctgtgccaccagagccagcctcacctgcagggtcctgtcctgcatgtcccagcagtctgggctggaagaacttgggaggtccatgcagggcagatgtggaggcctccctccatgtgcaaaaggtgaatcagagaggcgggatgtgctctacatcaccctcatggtagtagacggacccgaaccacgagttccagggcagagaccttttcacgcacactgatctctagatacattgaatttggctgtaaatcctaagggacactgtgctaaatattagggggtataatattagctcagagcaggcatcgctcatccagatacagaagactgggcatgatgtctggttgaaactttgtggcctatttttccacactcggcaaagacctgtgtgttgcctttggactcctctcctcctctgcctttttgattcatatttcctttaaagttgggagtgtttc

SEQ ID NO: 465413 - DNA, 1766 bp, Homo sapiens
cccaacaggttcccagggaaagaaagctccggagaggaaggtgacccttcagccacctccaggactgccctctgtgggtccttggggactgtccatatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcccacagctctcaaagccttcaatcacaccagtccctgcaaagtccaggaacccacatcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggtgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccatcactgccaatggccctgagaactctgtgggataaaatgacctgacttggatcatggccccagccccatccctcatttcatacccctgccatgcctgctgcagagt

SEQ ID NO: 465414 - DNA, 1703 bp, Homo sapiens
tgcgtgaggcgagcgccggggctcccggagcggatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcccacagctctcaaagccttcaatcacaccagtccctgcaaagtccaggaacccacatcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggtgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccatcactgccaatggccctgagaactctgtgggataaaatgacctgacttggatcatggccccagccccatccctcatttcatacccctgccatgcctgctgcagagt

SEQ ID NO: 465415 - DNA, 1253 bp, Homo sapiens
tgcgtgaggcgagcgccggggctcccggagcggatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcccacagctctcaaagccttcaatcacaccagtccctgcaaagtccaggaacccacatcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaaggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccatcactgccaatggccctgagaactctgtgggataaaatgacctgacttggatcatggccccagccccatccctcatttcatacccctgccatgcctgctgcagagt

SEQ ID NO: 465416 - DNA, 1247 bp, Homo sapiens
gggagcagaacagctttggtgaggtggacaggaggtgacctcgcgagcagacgcgcgcgccagcgacagcagcccgccccggcctctcgggagccgtggggcagaggctgcggagccccaggagggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagaatgtctgatgataaactgtgcacattccaaaatcatgaattctgtctaccttcctcacctcccagtatttgattgtctaataaagagtcagtattcctgtgagaaagtaccgttctctttaaatataaccaccctaattccctccatataaaaggctaatgaattagtttctctgtctctcactgcatcccatctccatgagaaaaacatattcagaatttaagaaaaaatgagcttattgttagtaggaagttgggacaaagtcttttttttttttttgagacagagtttcactcctgtcacccaggctggagtgcaatggtgtgatcacggctcactgcaacctccacctcccaggttcaagtgatccacctgccttggcctcccaaagtgttgggattacaggcgtaagccaccacacccggccaggacaaagtcttaaaggaaaactttcacatgaaagcagtggagacgaagaatgaggaaatgaggcacgggaaggacaacccttcctagtattctctccgaagaagagaatcaaatgctactcacttagcgggtagagagatcactgctctttgtagagaaaaacaatcatggcccaggaagtcatccatcactcatccataaatgggagagtaatatggacctagagttaaatttcacccatgaaacatcaaccacatgtcatatcaattcaagtgtgtaacattgatataatcgggtacaccacagcagcactgacagaaacagaaatgattcagagaaagccaattaaaa

SEQ ID NO: 465417 - DNA, 1117 bp, Homo sapiens
gactgatggagtgagggcggttgctatgggagcgcatacaagaggcactgcacgccgtgcttctgagaaggcggtaattacggtgcgctgaagagcaggctgcccaccccctcacttcaccaaagcttccctcgacaatgtcacacgcaacttccagatccaacccgatggccgactctcaatgttcctcttccaacagcacaactggtcactctctccttcctggagcctgtctcttcccctggcatccaggacttctgtgttctgtctccagccagcacctcctctcctggatccaaccgcctactcagtgtttccacctgggggtgcaatgggcatctccaactttccaggtccagaccaagctcccctggcccttcatcggtgcctccacagccctctttatctcaggaaatggcaacaccatccttccagtcactcagaccagaagctgggagccattcttgaccccttcctcaaactccccatcaacaacagatttatcgctgccttcagaatggatcttagcacatcccacaccacccccgagggcccatgcgccatctcgtccctcacctgggcttccaccagatccttggagaccctttgccttgtcctcacagctggcaggctgctgtcttccttgcagctgctcgtcacagctgatggcaccaggcacacagtgctgctggatgaggaaagacaggccatggcgaaatcccgccggctggagcgcagcaccaacagcttcagttactcatcataccacaccctggaggagagagtcatattcaaagagatctggaagccagaattcagatagaggggacagtagttcaactgtacagccctagacaggtacagagcagagtaatgggtctactaggcagaacactaacgcagggacccattatgggccagaatagagcaggtagaagctaccttcatcttgacagagcaggagcgtcgccatcttgaacaaacaccaccattctaagttcccctggattaaaaaactgcctaaatccagtccttatagttataaaaaggacaaaaatcagccagaagcccctcctgggtttatttctctaaaataaacttgtccttgactgtgaag

SEQ ID NO: 465418 - DNA, 2434 bp, Homo sapiens
  misc_feature (3)..(4): n is a, c, g, or t
  misc_feature (6)..(6): n is a, c, g, or t
ttnncngtttttcaggttttggatatgatgaataaggtactatcaacatatgtttttgtgtggaaatacgttctctttgggcagagatatctactgatgacacgaaaaattcttcagttgggtatggaaaatgcaatgataatgatgatgatgatgatgataatgatagtatcgaatcttgatagtatttcctgtgatcttcacgctgagaacctggtgggcccctggagcactcacggaagcctggttaacgttcctaaaacccgccggactttctgtaagaagtgtggcaagcaccaaccccataaagtgacacagtacaagaagggcaaggattatctgtatgcccatggaaagcggcgttatgacaggaagcagagtggctatggtgggcaaaccaagctgattttccagaaaaaggctaaagctacaaagaagattgtcctaaggcttgaaaagagaaacaatagtttcaaaggcaaagattcattaaagagaatcaatgcctttaacacagctgctggccaatgaataattacgtgatgatggtgtctatacgtaatggacttatttaacatgtgaaaagttgacttcagccactacagatttttttctaatatataggacgtcttttaaatatttagaaataacaaagtcattttcctgataataaagtgtacacattcactataaacaattataaaactattttgaaactgttagaaacaatacaaatatccactaatctcaccaactagagatagtattaataagctcaaattgttgtcattttgagtgtgtctttgaaatcaaatatatatataataaatacaacaaaacatgtatggtgtgagtgtgtttgaatcagatggttgtaacctgctttctttctcagcattatatcatgattgatttttcatattctctattattttagaaaatgatttttaataggctgtacttatcatgatttaccataatttatttaatccatttttattgtttgacatatttcaatataataagtatcacttcagagatacaattgtatgtttgtgaacttttctaaattcaattcatataaaaggatagccttgctttttaagacatgggagaaataaacggtgtagttcccttaaattgtggatagaaatgtaatggttatgagttggatgctatagaaaatataacataatatagagcatttcattatagaattctcttgaattagtttgcctgtacctctccctgttatggaaaggatataattttcaatgacaaaattttgaaaaggcctacatttatcaataaaaataacatacaacgtgaatgcaaatgaaaatgtagaaattaattattgtctattagcattattatgagttaactatcaaataattatggatttaaaacaggtgaacaaaaggaagtccagatggaagtgtttgaaatttgagaggcaatctatgtcttcccaatcataagacgcctcacaaaataaaaaaagaaaaagaaagacaagagatcattagaattttattaagtgtgaatacatattatgaaagaatgcatatattttgaatttttaattcaatcttttagatttaattttattagtcataatctatattgcatgctggctttctaaagatcatccgttaaatagttctaattttgatatattttgtttcctctcttattgctttaggcagagttatatttagcgttgagaacaatttcattgattatactataccggaattgaatggaagaaaaacactaattcctgaaagaaataaatttaaatgcaggaagacctagaaactagaaaaacaaagtacgttggattgttttacagtttagaagtttctggccccacagttctagaggctgactgactggggcaggttgtagagaaacttctggacaggttgttaacatctgacacagtgagtgagaaaaaatccagcacagtcactgggcaggtttaagaagaagtggcagcctcgggagatgaaaggtttgtgtgtgcttgttgctggttacctgcaacacactggttaaattcaaatccattcatttagtaattgcttagcttcctctaaaccaatgtaatgcaaaccaaaaggaccgttgtggatgttttgtactgatgtctgcagatcatgagtaattttagtctgtcttgtctgacattttccacaatgcttttagttgacagcattatattatgtaaatatttctggttaggtttattgaggtggttgcctaaatctcactttaaataaagcctttaatgctttcacccagaatccatagagaagctacatgagttggggaagtttagtgttgctctttgtactttaacttttaatatcagagcacatattgaaaccataaacacaatgaaaatacaaaaaaatattccgacgatatt

SEQ ID NO: 465419 - DNA, 1317 bp, Homo sapiens
ttcaatccaaagcagggaccttgcctcttggcgaacatgcacatgctgctgttggcggcggcggctgcggctgctgctgtggcaggattttcaatgtggtgtgttttcaagcctcactcactcatcctctcattcccaaacattcagcatccatgcacactcctcacttccaggtttttcaaaagattggagatttccagtgggggtcctcagagtgactggcaaacttggtacaagcagcccatgggtgttgcggaccctccacagtatttctggacaaattcactacttacccaaagtccttgtgagcttcgtggactttattggagactgtctatgggagagaagatggatgagtgcgtgccaccacctgatggaagattcgtggacatggggatgaggcccctgaggccccagaactatcttttcagttgtgaactaaaggccaacaaagattatcactttaaggtagataataatgaaaatgagcaccagttacctttaacaacaatcaatttaggggctggtgcaatggatgaattggacattgttgaagcagaggcaatgaattacgaaggcagtccaattaaagtaatactggcaactttgaaaatgtctgtacagccaacggtttcccttgggggctttgaaataacaccaccagtggtcttacagttgaagtgtggttcagggccagtgcatactagtggacagcatttagtagctgtggaggaagaagcagagtcagaagatgaagacaaggaggttgtgaaactcttaagtatatctggaaagcagtctgcccctggcggtggtagcaagcttccacagaaaaaagtaaaacttgctgctgatgaagatgatgatggtgatgattttgatgataaggaaactgaagaaaaacaccagtgaagaaatctatatgagatactccaagccaaaaatgcacaaaagtcaaatcagaatggaaaagactcaaaaccaccatcaacatcaagatcaaatggacaagaatccttcaaaaaacagcaaaaaactcctgaaacaccagaaggacctagttctgtagaagacattaaagcaaaaatgcaagcaagtatagaaaaaggtggttctattcccacagtggaagccaagttcatcagttatgtgaagaattgcttccagatgactgaccaggaggctattcaagatctctggcagtagaggaagtctctttaagaaaatagtttaaacaatttattaaaaaattttcatctcatttctgtaacagttgatatctggctgtcttttttataatgcagagtgagaaatttc

SEQ ID NO: 465420 - DNA, 4093 bp, Homo sapiens
  misc_feature (212)..(212): n is a, c, g, or t
  misc_feature (219)..(221): n is a, c, g, or t
ttgggagtctcttctacttcctgccctccttcccagtggcagctcctgagctgccgccatggatcagggtttgaaaaccactgggggagatgctacttccgaagaaggccagggacagtctgagagaatgacatttgaactgagatctgagcagagctggaagaaggcccttctgggcatgggaacagccagtgcaaacaaaggccctgagntagggcnnngaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaagttgctgaagccagtagcttcgtcaaaaacatatgaattcatataaggaagccctttagatggtacattcactaagacgtgtctgggtgtgatcctgtttgggaaaaacagaatcctaggttctaaacaagaaaagaacgcccttcccaaagggtccgcacactttctgctttgcagcggatcaagtgtccttgtgaggaaccccattcctcccactggctgagcttttcctttcctttccgggtcacccatagaccctctccgtctgtaccagtgcgtctgtgttgtgagcgtgacgaagcctttcctgtgaagagctttcatgaactcattctcatactccttccccatttccacccatggtgtgactgttttgctattcaagactatctgtaaaaatgtacaaataaaagtgaaaactgaaaataaaggggagggagattgagattaaacaaatgcaatgatgtagcccttagttttctgaggacttctgtggacggccctaaaatcctgagttagggtgggatatgaagggagggataccattgacacaggaggtttttttctggttgtttctctcacagtcatcagtgtctgcttagaactctctgttctaaaggtttttccctgtaaagtagaatgcacttcccccaaaataaaagtaaatcagcaatgtttgaagggtcatggcaagggtcatgacaaagacctgactctggggtggcatgagtggccctgtcaccggctcactcagggccttgggggagtctcattacctcaccttgtctccacgtcttctcagccaaatggggatcaggggcttccagggctctgggggtgcgcagtccccttgtgtattttgctgctatttctagagagactttgagcccttgctagtgcgtgcttactgcatggaggtaaattaggagatgttttctctctgctactcctggcctctgctttcgcccctcagaaagtgaccttgagctagcagccagtttgcactcagagtccagagccttctatctaccgtttcattctcagattccttttcccacccactttgacgatctcattttactatcagtctctactgactgagctttgctgcactgggctggggtaggagaaagagcatccaaggagatgatgtgtgaattgctttgtaatttatgactcaccatataaatgtggcttgcagtgtcagaagcagggagtctggccaagggttgctaccaaataagactgaagatggtggaggcagtggtggcgtggaggcagtaggcagaagatgtgggttgggagcagaggtaagatgaacggagctttgggaaggacagatggcagaagcaccagaaaatcctcagcaaggcagcagagaaggatcctcaaagcagtaaccctgaagtaataggaagtaggaaagaggagcagggattaggtaaatctgcagcataaacagctgtctccctgcaggactgagaagaccagctgccccagagaggggaggcacgtcgagcttggccagtgacccaacccatgattagaggcaccttcaatcccaactttcctctcctctgctgggtcacagtgatggaaccagcttcaggaaggtagtatagaccagcgtcatccaatggaaccatgatccaagccacatatgcaatttaaaatattctagtagccacattttttaaagtccaaagaaacagctaaaatcagtgaaattaatttttagactacattttaacctaacatgtcaaaaatagtatcacttcagcatggaatcaatataaaaattactgggatattttacattcttttttccaaatgaagtcttcaaaatccaatgtgattttcctcttagaaaacatctcagtctggcccagccctatttccagtgttcaatagccacacctgactactggttgctgtataggacagcacggacttaggttcttcattaggagactgatggggggggtccttcctggtgggtcactcactgccatagctcttgtcatagctgatgaaggcaggagtgagtcttattatgttggcctagagtagaaagcacagagctatgtcgaggctgctgtctcagcctctggaagttctgcttcacctgcttagtaagaggagatgaccactcctgtggactgcatgtcccatctgcccccagagggtgtcggcgctgccccagtcatgtcccttatgacctgtccaagtcctagaggccaaagcaggtcatattcttcagctgcaggaatgtcagctactgcctcccaccccttaacctgatccccttatcatatagtggggaaggggcaggcaggccttctctctgtcaagaacaaagatctctacaacatttcgtcacctgggccagtcacctgctaatatcatctcaccaatatttggagctgttttctgaatcccttaattttcttaaatatttatcttaaagtcaaatgctataaaggagataccctgggaagggcagtggccacaggcagactgggtctcctaggaggtggtggtgttggtgacaagttctacttggactgggactcaacccaccattgcctacctctcttccctgcctggagaccttccttaggattgaagaaacctcttttgtttgtgaaaaagataggtatcgagatcttaatggagagaacagaataaaatgcaaggagccaacccctgggtattctcaaagcatttcaacggtcagtataacaaggtttgattgatttaaaatataacattctgagccctgtgttactgagcaaaaatgagctgatttggtgagtatgttttatatatggtcattagacagggaccataactgacaaaactctcaaacgcctggagtgtttatggcccaccagattattgctcagtcaatataaatttatttacctttattttaatttgcatagtgctttctgattggtcagacaaggagtggtgtgtactgcaggattctaacaatgcctctgcccttggaggcagcaattcctgtggttattggtgctaaaataagataaaatattatgttaatttgttctgatatgatgtgaataaatgtgttgtttaatcttaacaagaatgctacatcttatcagatctattgtactgtctgttccttctcataattaattaattacaggaaaggcgattcaaaccagatcttgaaactattgtgatgttctgagaggtaaatttaacagggaagtgggaggggggatgaaaagggaaattgccaggttcctgtgactttgaaaggactgaggaagcagagagcatttggggacttcactgaaactgactgcatcttgcaattttctttttcgaattggcagaaatattgtatttccatcgattgaagaaaaacaagtgtctggtaattaattaaatgacttgttcatggaaaaaataaataatctgtcagttgtggaatgtaaactgattaaacaattaaataaagaagattatgttgtgtgttttaaaaaaaaat

SEQ ID NO: 465421 - DNA, 1586 bp, Homo sapiens
gctaaattaatgattagacatgaacatgaggaggctatctttctggcacatggacccagttttaaagagaagactgaagttgaaccatttgaaaatattgaagtctataacctaatgtgtgagtactcagctggaacaagtgaatcagatgctaaatctcacccaagaagaaagactctccaaaataagctgacagaggttcctgaacataaagattttattgccaatatacaaaagggtactgcagaagaacgtggaccactgtctcctttaccacagggaatatgtcagtggatttggaaaagctatgaggatgcccatgtggagttcatacacagtcccccagttgataaaggttgttataggtgctacacgggtgcaaaagaggaacacattgtgttttacctggagaaaatggaaaatgtttacaggccaattggccaattgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgcacagaacttttgc

SEQ ID NO: 465422 - DNA, 1230 bp, Homo sapiens
gctaaattaatgattagacatgaacatgaggaggctatctttctggcacatggacccagttttaaagagaagactgaagttgaaccatttgaaaatattgaagtctataacctaatgtgtgagtactcagctggaacaagtgaatcagatgctaaatctcacccaagaagaaagactctccaaaataagctgacagaggttcctgaacataaagattttattgccaatatacaaaagggtactgcagaagaacgtggaccactgtctcctttaccacagggaatatgtcagtggatttggaaaagctatgaggatgcccatgtggagttcatacacagtcccccagttgataaaggttgttataggtgctacacgggtgcaaaagaggaacacattgtgttttacctggagaaaatggaaaatgtttacaggccaattggccaattgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttcctta

SEQ ID NO: 465423 - DNA, 7893 bp, Homo sapiens
catatgccaagtactgccaaagaggttcttgcatttgaaggcaggggacctaaagaaaaagaaggggctacctgtgtggatgtctacgggaggagcatttcaggccatgggaacagcaagtgcaaaggccctgaggcgcgagtgtgcatggaaggtacaaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggggagaatttcgatcgccaggccagccttcggcggtctctaatttacacagacactctggtaagacgaccgaagaaagtcaaaaggagaaagactattacaggagtccctgacaacatacagaaggagctaggcagccacagtgacccagatggtatacaggtgtttgccctgttctatcatggattggtttattacaaacaaaggcaagactgcagcagctcccgtgggattgtgaagtctgtctttggtaacaagcctctttctgctttatctccagcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaatatttgaaatatttctttttgtttatacatgcattttttttgaataatgagataggtgttcttatacagaattgttgagtgttttgctggatacaaacagaaaagcagtgagaccagaaggtctctgggggaggtgacaacccaacagaggaggtggaacatcacagacactggatggcaccatctacaagggcacgtggaaaaacaagtccacatcgtgtcctatggactttggaataaaatacgaataacctatcgcctggcggttcagatgacgtggcatgtggagagacgtgagaacttcttacaggcatggatgaaatacagggagagaagaatcgagactcatccctgaaacatggcaccttccatgtggctactctactccttggggcccgcttctgttatggaccgcatcttaaaaagctccacaggggtagatctgatggctctcataccctcatactttaagttccagataatcacagaagccccagccctaaattatttccactttatttttactatcagtggggagagaaacaaattactgcttggtctgtcagttggaaacaacctcaatgcgatctgctttctgccatcctactatttctgaagaatcttgattgaactcttgcttttcctgtgggggtgactgtatattccttaggagaatcacagtgaaaaggagacgtttctgtgtctccgtctttctccccacccaccactggcaccctgctctgtggtggcatcttaggaggagaggggaaagagtggctttcttggttctgccgtagtaggggttcagcctgcatgcgatgctgattccatcatcaaatgagcacagcagcataatttgctttggcagatgtgaggatgttgttgggggaatggagggtcatttgaatgaaacatggacctgattgttgcgccactttccttaataagccactcggtaactgtaatacagtttctctcagttgcctgctctgacctaccttccacagcggccagcctttattcacagaacaagaggtagagcaatctgtagtcatttgttcagcaatgggggaaaaaaagtcctaataaatgcttctcatgtgctaggt

SEQ ID NO: 465424 - DNA, 925 bp, Homo sapiens
tctcctcttctctcctcttctctttctttcacaggggtgttggatggccacccatagggattctgaggccactcaggataacaacaggagcttgaaaatgaccaaagatcggaaggagagacatgatactgccaaatgtcaggaacatcaggaggaggaatttgatggggtcctgagagaggaggctgtggccaaagcactccatcacttggggcgctcaggctctgggactgagcaagtctacctcaatctaactttatcaggttgtaatttaattgatgttagcattctctgtggatatgttcatctacagaagttggatctttcagcgaataaaattgaagaacttaatgcttctcaaaataatttgactacgttcttcaatttcaagccacccaaaaacctcaagaaggcggatttttcccacaaccaaatttctgaaatttgtgatttgtcagcgtatcatgctctcactaaactaattttggatggcaatgagatagaagaaatcagtggactagagatgtgcaacaacctaattcaccttagtttggccaacaataagatcacgacaattaatggcttaaacaagttaccaatcaaaatactttgtctgagcaataaccagattgagatgatcacaggtttggaggatctgaaagccctgcagaacctggatctgtcccacaatcagataagcagcctccaaggcttagagaatcatgacctcctggaagtgatcaacctggaggataataagaagcaagatatcagtctgggagtgacttcgaaaaacgctgtcttacttctctaagtctcagtgtcgttatgtcacactgttggttcccaattacttttctgaatttttgtgaggattcacaaggtaatactcataaagcaatggcagcatggagagaacttgaat

SEQ ID NO: 465425 - DNA, 841 bp, Homo sapiens
caagacgcaacacacaaaacaaacaacaaaccacacaacaacaaactctcgagtctcgtcggacgcgtggatgtatacgagcacgaggggtcaggtctcagagtctgcatggcagtcaccattgtcttgacttgggaaagaatctgacccccgcagatccttcaatcaggggctgctgctgagcttatgatgatttttcttctaaaggtcagcaactcattggggctgatggcgtccctgccctgggcagacaggcaggacttgctcatgagtctctgtatcactcagctccaggagactcagaatctcaccaggacacgtccatcactctctcatagctggtacttggaaatgaaagagactcgcagtgcagtcccaatcaatgtccgtcggccgtctctgtcgataactgccgggctgtccaatctttcccctgatagaaaggcgcctgggggtcagcctgaagaagctctggagggaagaggcggctgtttgattcagagcctcctcgctgggctggaattaacctggctctttctctaatgaaactgactccaagggtccctgtgtgctagagattcaatggcccttaggagaagcaatgatgagaggtaatattaaagcagtgtacacatgcagcctcgaattcctaaccacgctgatgatgttttcaaggtgctttgagccctgtaggaagcagcacctgtctggcatgatgctgaatgcacagtagaaacagtgaatgcagggagagtagaccctgggctgcctttcctatctactgatgaagagatcaggccttaagaagcttagtgacttaaccacgatgtcagagcacctt

SEQ ID NO: 465426 - DNA, 1744 bp, Homo sapiens
tccattgacaccaactaggtgggtgatgtgtttatgtgagatgctagaaatggtacacttgcccaacacttgcacaagaactcacagtaatgcccaatttgatgcaaaggttacagtgaactgcaatgtggtttgggcaaagtcggtttttacacttcagctggggatgaatgagttccctctaaagcgacggggaggaagtaagaatgccaccaacggaagtccttgccgagtactggatgctcagggctcaaagaagcctcaggctcgaggttcacagtgctacgatcaggcaagggagaaaatgcatgggattgggaatttctggcaagactgggaaatgtctccggatttctccccgctgtactccgcttggtcactgcagctccactgagctgtcccttccctcctccctctctttctgcttgggtcttcagtaggtttgaactctccctcctcccacccaagacagctgagtttgaattttggctgcaagattatatttaatgatcatggaccaggaagggagacctagagggcaagcctcattaaatatttatatgaagtaataatctggtttgcaaaactgcctgggtgcttgcagagctggggccactctttatccaaggctgttgatacaagggacacggttaattatctcttgccaaacataataaacctgtgcgaagtcattctctgagcattgcctgggtcagggtctcagagtctgcatggcagtcaccattgtcttgacttgggaaagaatctgacccccgcaggtaaggggaagagccagggtctacgctcatcttccgaaggtgtttttcacctctccaagtcccggtcacttcatctcttagatgggagttaatttagtcaacaaatattgattgccatgttcctatgtgttggacactggggtttagtggtgagctagatggacatggtccctgttctcacaatgctctcttttaaataagagaggtgaacaagaagtgaataaatgaatctacgcacagtgcgatggctgtcaggcagagaaaggtgctataaagaaagatccttcaatcaggggctgctgctgagcttatgatgatttttcttctaaaggtcagcaactcattggggctgatggcgtccctgccctgggcagacaggcaggacttgctcatgagtctctgtatcactcagctccaggagactcagaatctcaccaggacacgtccatcactctctcatagctggtacttggaaatgaaagagactcgcagtgcagtcccaatcaatgtccgtcggccgtctctgtcgataactgccgggctgtccaatctttcccctgatagaaaggcgcctgggggtcagcctgaagaagctctggagggaagaggcggctgtttgattcagagcctcctcgctgggctggaattaacctggctctttctctaatgaaactgactccaagggtccctgtgtgctagagattcaatggcccttaggagaagcaatgatgagaggtaatattaaagcagtgtacacatgcagcctcgaattcctaaccacgctgatgatgttttcaaggtgctttgagccctgtaggaagcagcacctgtctggcatgatgctgaatgcacagtagaaacagtgaatgcagggagagtagaccctgggctgcctttcctatctactgatgaagagatcaggccttaagaagcttagtgacttaaccacgatgtcagagcacctt

SEQ ID NO: 465427 - DNA, 1712 bp, Homo sapiens
gagctcctggtgtatcacttctggaccttctgagtcccaggatgcaatcagccctgcaaatacccgaccttttctctaactacctgttcattgtctcaaaaagcgctgtgactgccgatgcaacgtttgtgaggagtcctacagagtgcgctgccccctgcaacctcaattactgcaacagtcccttccacctcaagctccacagtctgactttcaaggccagctttgactcctccctccttctccaacctacttctgacaccgcaaatattcctaaacaccctacaacttacaaagctctagatgcctgtaggatgcacttttatgtaacagtaaccatcgcaatgataacatttgttcatccaacacatattgagtgcttgctgtgtgtcaggcccccttcaagcctccaaggagactccagagaacaaagtctctgctcttgtgggttgacactggggaggaggcttctctagtctgtttttttttttcatagatcccttattggtcacactcatttccacctctacaaatgttccctccttccttctcagcctctttcctcccctccacttatccaaatcctccattttccatagaagccagccaggctgaaaatagcatgttatgttcctacatgtgatcactggtatatctaaacataaacactaccttatcacctctactccctcccacagggatacacacctacctaccgagagacctccaaacagagacatcaacacagaaacctccgcagagataaccagatctccatatgcaaacccatgtaaaaagaaacctagagaaacagatgcccagatgaagaggggtttccagacagattcttggctgacgtttctgtcagtggtgtgaaaggacatttacccagattctatagatattttggttatgcactcaacaaacctacaatgaaactaccagaatacaaaagcaattgtgaactccagagagtgctagaaaacattatggaagagggtatagtttatgttaattatagaggactaaagagatgtagaataggagagctgaaaaagcctccacttccagtggctcttagagtgtaattagtccaagggacagcaagctgccttctagcagaatcgttgtgatcccaaagcccacatgactggggcctctctctggtcctttatacagtaattaatatttaaaagatctcgctaaagccctgtcaagtcctgaagcaagattttgaaaaataaaaaaactcataaaacacaaaatagaacaaaacaatgagctctgagtttgctttgttgaaagcaatgggttgaattgtgtctccccataatatgtattttgaagtcctaacctctagtaccttagggtgtgaccttatttggagatgcagacattacagaagtaatcaagttaaagtgaggtcattgggatgggccctaatctgatacaactggtaatttggacacagacacattcaggcagaacaccatgtgaacataaagatggtcaggtacaagccaaaggggagaggcctggaacagatccttccttcacaggcctcagaaggaaccaaccctgccaacatcttgatcttggacttctggcctccagacctgtgagacaacaaatttgtgatcttttgttatgacaatcctagcaaaatacactgtgacacccagtttctaatctgatgacaaacggaggcatct

SEQ ID NO: 465428 - DNA, 1442 bp, Homo sapiens
gccgtgcccctcatccccacagatatgtggcatcccactggtctcctaaccacccaacgccgttgctcctgaccattggaaacgctggtggggctggagcacctggacagtccagtctcgttctagtggctggactggagtggggttgccttgaacccgtcttaggctggaaatgcccccagcagcagtgccaggggaactctcactggggcctgccctgggagccccggggaacacttgtcagttcagctctgaccttaagccacccgtgggcttctggtcatattgtgatgaccctcgaaagtgacggatgccgtgaggccgtgggaacaggagctaggaggctgcaggccggccgccttcagtccacagaagccagatttgaggaggtgacggtggacaggcctgtgaacattccgctcttgctggagccaggcgaggctgccggaggggtgctgggctgcagcatccctggggcaggtgcctgtctccctgcctgttggagggagaatgatttccttgctgccaccatcaccactgccatgaccattactatcaccatcaccaccactgccaccattgccatcaccatcaccaccactgccaccaccatcactatcaccaccaccaccactgccgtgaccatcactatcaccatcaccaccactgccaccactgccatcaccatcaccaccactgtcaccaccatcactatcaccatcactatcaccaccactgccatgaccatcactatcaccaccaccaccactgccatgaccatcactatcactatcaccaccaccactgccatgaccatcactatcaccatcaccaccactgccatgaccatcactatcactatcaccaccactgccatgaccatcactatcaccatcaccaccactgccatgaccatcactatcaccatcaccaccactgccatgaccatcactatcaccatcaccaccactgccatgaccatcactatcactatcaccaccactgccatcaccatcgctatcaccatcaccaccactgccaccattgccatcaccaccaccatcactgatcaccatcaccatcaccatcaccaccattgccatcaccatcactatcaccaccaccaccactgccatcaccatcactatcaccaccaccaccactgccatcaccatcactatcactatcactgccatcaccatcactattaccatcaccaccactgccaccactgccatcaccatcactatcaccatcaccaccactgccatgaccatcactatcaccaccactgccaccactgccatcaccatcactatcaccatcaccaccactaccatgaccatcattatcaccaccaccaccactgccaccactgccatcaccatcaccaccatcactgatcaccatcaccatcaccttcattgccatcaccattacta

SEQ ID NO: 465429 - DNA, 832 bp, Homo sapiens
gcagcgccgtcagggcatgaggatggccgtgggctccgtcaagatgcagccgccgtgcgagagcccggccctggccgccgcggcggcggtggtggcggcagacggccccctgcgccgcagccccagcgcccgggagcccgagcgcgagcagccgccggcgtcgctgcggccgcggctgagggacctgcccgcgctgctgcggagcgggctcacgctgcggaggaagcggagcgccgctgggggccggactctatcaagaagaatatctaatccgtaccttgaacatacgccttcccagatttatggagagaattcttcttgtgcaggaagagcattgaggaatattattatcgttcaagcagctgacctgataaaggacagagtgaacctcaaggggttttacaggaggagctgcgttgggtcagagctggtagactggcttctagaacactgtcctttcgtccagtgcagatctatggccataggagtctggcaactcctactggacatgggaattatgttatcagtggaccagcatctatactttcaagatacttatgttttctaccagttttcctctgatgaatgtagctacttgtactgtgaatttgaaagagaagaagaatggcaaaatggtgtcaagcttttactgcaacttgtgcctctcattcctgccagaggtggcatctgtgaactgtctcatcagaaaattgaagactccgaagaaagcagtgatgaaattcttgtgcgtctaacatctgcggtgcagagagagctagcagctgttattgctttgaaagcaaggaagtctgcaattgaacaagatgaagaa

SEQ ID NO: 465430 - DNA, 1075 bp, Homo sapiens
  misc_feature (1063)..(1064): n is a, c, g, or t
  misc_feature (1066)..(1068): n is a, c, g, or t
  misc_feature (1070)..(1070): n is a, c, g, or t
  misc_feature (1072)..(1072): n is a, c, g, or t
gcagcgccgtcagggcatgaggatggccgtgggctccgtcaagatgcagccgccgtgcgagagcccggccctggccgccgcggcggcggtggtggcggcagacggccccctgcgccgcagccccagcgcccgggagcccgagcgcgagcagccgccggcgtcgctgcggccgcggctgagggacctgcccgcgctgctgcggagcgggctcacgctgcggaggaagcggagcgccgctgggggccgggctgcacctgacttaaccccagggcccccagattcaggctgcgggaccgggcatcggctgaagacgagctgtttgcctcttctcggaggggaagctgcaggtgtccagcgtccaacagccagccagccctgtcccaaccgcaagcttcaggccccacgagcggcatccctgtttgcaggacgcatgcgacgtgtgtgcttgttttggaggtgctgttgcaagctctgggcatcgagactggttttggtggtctccaccgccgaggggcagacccaggagtcggaagctcttgggtgagcttccagttcctgggttccggtgtctccagcacttaatactcctggacaccctcttgagcaggagggtgcacgcccccaagaaccttcaatattgacttcctgatggtgtgttcagatacgatttcctggtgaaggagtgtccctcattgagttctaagtgcatctaatgacctgagcaggtcaggcatgttttgtatttttaagagaagcaggaaggtctgctgattgtctcctgggatctttaagaagccacctaggaggccccgccagggcctcaggacacagagctgacttactcagatttccctgctcaccagggtttggcggcacctttggtgggttctactcatcttttaaaaatttattattaagtggtctttaatgagaagctgcatcaatgtggtttttctttcccgtttggctgtaatttttaaaatgcagtcttgtctgacttaaaacaagaccttgctgggagacttctagctctttcagagatgggtttgtgtaaacttgagannannntnancac

SEQ ID NO: 465431 - DNA, 931 bp, Homo sapiens
gcagcgccgtcagggcatgaggatggccgtgggctccgtcaagatgcagccgccgtgcgagagcccggccctggccgccgcggcggcggtggtggcggcagacggccccctgcgccgcagccccagcgcccgggagcccgagcgcgagcagccgccggcgtcgctgcggccgcggctgagggacctgcccgcgctgctgcggagcgggctcacgctgcggaggaagcggagcgccgctgggggccggactctatcaagaagaatatctaatccgtaccttgaacatacgccttcccagatttatggagagaattcttcttgtgcaggaagagcattgaggaatattattatcgctcaagcaatcctcctgcctcagcctcccaaagcgctgggattataggcatcagccaccatggttggcctagataaattgttattatattttgcctttcaagagaaaaactaaaagaaatagaaacagattttttttgtgtttgcctgagtttatttcacaggtggaaatcaaagatggtcttaatgtatttttgcaggatggggagacattgactaaattatattttaaaatattagcaaagcctgaaataaagtttattccaattttgcaattgtatatcagtgttaaagaatatataatgctgtccaacaaccctcaagtgtttgatgtcatagcattccctattcctagtcatctttttaatgtgtccaagacactcagcttatcattttggagacaacaagaatagattggtttagaatatgccaagctgctgttgcattcctagtcatttaaacactttgcctttgaggttgttatttttatgtaattttaacagcatagtttacatatggtcatcgtgtataaattaggaaatgctaataagtacaataaaaataaatcgagatgctctaa

SEQ ID NO: 465432 - DNA, 1344 bp, Homo sapiens
aggtcccatggggcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaagattcagaggaaaatgactccagtgtgtgcttggattgggagccctggagcaaaggcccagctgagttttgctggaaggggacactccacggccaagagaaggagaggccctgctggtgagcctgctgtgccaggtgaggcccttccaggggccagggggagcctcaaggcccacccaaagccttgggcagctgctatgtgggcaagaggctgcctccaccatattagagtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaacctaccaggcctgaccaagtcattcattcaaccagcgtaggtgcagaaagccaccttttgggatttgagccccactgaatttgctggatgaggtttctattcttacccacaggctacaatgaacactcttgaacctaaatccttgcccacaagtgtgcttctatccagagaacacattctgaaaggagaaattgttgaatataagacatgcatttacattttgcagaaactaagttgctcgaccaaaaagtggccccaagggtacattagaagtacctgtttccccagtcctttgccccgctgtgcaatcccaacatgctctcttacatacagacacacacacgcattatcacacactcacacacaccctcatacacacactctcatagacacacacagacacacaccctcatacagacacacatacacacacacaccctcatacagacacacatatgcacacagacacacaccctcatacagacacacatacacacactgtcacacagacacaccctcatagacacacactgtcacacagacacacatacacagacacacaccctcat

SEQ ID NO: 465433 - DNA, 452 bp, Homo sapiens
aggtcccatggggcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaagatattctgcaagtcagaagatacagatatgatgcaaacattttaacagcttcatgacaagccatcagacggagggtccgggtctccatgtggtgtgactctcccacagcttagtcacccagatctctcgtgatctgtggacgtggacacagtttccaggtgttttattgttcgtgtgtgcgtgtttcatcacaaaacagggctacagtggagatcattgtgcctttgtactcagatgtttgttaatgaatgaactagtggaaaag

SEQ ID NO: 465434 - DNA, 1230 bp, Homo sapiens
aggtcccatggggcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaagattcagaggaaaatgactccagtgtgtgcttggattgggagccctggagcaaaggcccagctgagttttgctggaaggggacactccacggccaagagaaggagaggccctgctgtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaacctaccaggcctgaccaagtcattcattcaaccagcgtaggtgcagaaagccaccttttgggatttgagccccactgaatttgctggatgaggtttctattcttacccacaggctacaatgaacactcttgaacctaaatccttgcccacaagtgtgcttctatccagagaacacattctgaaaggagaaattgttgaatataagacatgcatttacattttgcagaaactaagttgctcgaccaaaaagtggccccaagggtacattagaagtacctgtttccccagtcctttgccccgctgtgcaatcccaacatgctctcttacatacagacacacacacgcattatcacacactcacacacaccctcatacacacactctcatagacacacacagacacacaccctcatacagacacacatacacacacacaccctcatacagacacacatatgcacacagacacacaccctcatacagacacacatacacacactgtcacacagacacaccctcatagacacacactgtcacacagacacacatacacagacacacaccctcat

SEQ ID NO: 465435 - DNA, 3485 bp, Homo sapiens
  misc_feature (1)..(1): n is a, c, g, or t
  misc_feature (4)..(4): n is a, c, g, or t
  misc_feature (6)..(8): n is a, c, g, or t
  misc_feature (470)..(470): n is a, c, g, or t
  misc_feature (475)..(475): n is a, c, g, or t
  misc_feature (479)..(480): n is a, c, g, or t
  misc_feature (482)..(483): n is a, c, g, or t
  misc_feature (485)..(485): n is a, c, g, or t
naantnnnaggatttggatcttgtttttttgggttccaatcccttgctccagttaaaaaactaccacataaaatggtgagaaaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagnctgtncttnncnncngagtcttaccagcaaggggtcctgtctgccaccatcctctatgagatcttgctagggaaggccaccttgtatgccgtgctggtcagtgccctcgtgctgatggccatgggaaagcagcattcccttggacatctgaagtgacagccctctttctctccacccaatgctgctttctcctgttcatcctgatggaagtcctcaaacaccatttccatacccaggcattctgggtccccactggagggttagtctgaagggcaatggctgggctttggaaaaccagcaagatgaggacagagaggaaggcacacagcaaaccataagcccttacccagtgcaggacagaggatgcgggcagacctatgggttacaatgtctggtcatttcccaattccagattaaactgtcacctgttttacctttagttttattagtttgtagtcttaacacctccagcttctcttgtttcaggatttgggcttaaaattgagtgctactctgcatgtctagtttgaaatactagagaaggcagagttgagacaactgatatgtaaagcctggggaagagtgatttctcaggagcgagacacactaagtcaggagcaatgggatatagggcccagtgggggctgaagtgctatgttcagagtagcccttccaatgggcttcttcgtttgatggatggaaaccaaaccactccaaacacaaggtgttaactgctcctacttgggcaaagacagttatcctgtcaaggcatggtcttaggatttagggcccaccctaaatccagaacaattttattgagagatcttaacaaattatacctgccaagtccctatttccaaataagtcctgagtggggatggggtggagagaaagtggacagtgggtggtgggagatacagggagaaagaatgagaattgctcttgttctcaagggtaccgcatcacgttttcctctggctggcagtctttaacaccagcgtatcctatgagacctgacttcactcatcagctgcatcagctcagtgtcattaccacatgtagacagcaatgtaatcctccttcttagagatgctgcagcagattggagggtgaagagatgtatcagtcagatcagagtaaccagctggctcctggctcctgatcattgtcacagctcagtagctggaagctccttccatatggctgatgcctttaaaaaaatctcctcaatctccatccccatctgcaatactgtttagttattcaatcatttaagtcattcatgtattgaaaagaggatggggatatgatccctctgctctgtggcagtagatctactaatgggagagtcctggccgcacatctggcctgggtctggaggtgcctacggaattgaaagctggctggaactgtcatcttaacatgtcctggtcatcttaacgtgtccacctctctggcaagcctcttttcaagtctttttgttaccatcttcagctttttccctccatactagattcttaatgaattgctgccaacaagagaaagctttatacatgaagagaatggcaataagaactaactcgtctttttaattttaaaactggtatatattcctatataataggaatggaagatacttgcaaagcctatttgttcctctacagaagagttaaaaattacctgggctaatggaaagaagggagagtcagccaattagatgctcctgaatgccctgaattgtgacttacctcttcttatccacatcctgatcaaggaaagggatgagagagaggtggagagagaagaaatggaaattcaaaagttttgacggcagaggaaaattgtgcttatttccagaatgagacgaacaaggtcctgggtccctacatgtcatactggctagagactgggaaacagattaactgagagaagccatcaagcctgaagagacatcgtgtttgaaatgtgtaaggcacagtgtacccgccgtggatcaaaacaacctgaaggacagacagacagacacaccgaggatcagcagatatcagtggggacaggtgctgatgatggtgcaaatgagagtcatgaaggaaagttaaatgatgaccaaagaccaagtaccttccccacaatgctttgacaagcgcttttataagcaccctggaatttagacactacccggggagaaaaggaaagggagacaagcatgaattgtctgagaaacccctgaattaatcatgtgtaccccaatgcaacaaggatctagatatagaataattttaattatagaaaacaaaattatattttacccacccatatttgatgcccatgaatttcacatctaccttacgtgcacataaaattcaagcttagatagacggaaaacaaaaaatcaagaagcaatatttgccttctaataacttatctattggaggaggtaaaagatagaaaagtagttcagatgacaaatactaaaagagttaggaacttctgcttccacttacgatgaaggaacttgtactcaatccatccactttgtaattctccttgagctgctgtaataaagtaccacaaactgggtgacttaaaacaacagaatttattgtctcatggttctggagcctagaagtctaaaatcaaggtatcaacagagctatgcttcctctgaaacctggaaggaaattcttccttgcctattcctagcttctgttgatttgctggcaaattttgacattccttaacttgcagctacataactttaaactctgcctttggcattacatggcattttccctgtgtgtttctgtcttcccacggctgtcttcttacaagtacatcagtcatattaggagtccacagtgctccagtatgacctcatcttaactagtcacacttgcaatgaccctattttcaaacagagtcacattctgaggtactgagggttgggatgtcaacatatctttttctggggggatggtgggtataattcaatccattataccctccaataataaa

SEQ ID NO: 465436 - DNA, 2913 bp, Homo sapiens
ctagctccaaaaccatcccagggaaagcagcattcccttggacatctgaagtgacagccctctttctctccacccaatgctgctttctcctgttcatcctgatggaagtcctcaaacaccatttccatacccaggcattctgggtccccactggagggttagtctgaagggcaatggctgggctttggaaaaccagcaagatgaggacagagaggaaggcacacagcaaaccataagcccttacccagtgcaggacagaggatgcgggcagacctatgggttacaatgtctggtcatttcccaattccagattaaactgtcacctgttttacctttagttttattagtttgtagtcttaacacctccagcttctcttgtttcaggatttgggcttaaaattgagtgctactctgcatgtctagtttgaaatactagagaaggcagagttgagacaactgatatgtaaagcctggggaagagtgatttctcaggagcgagacacactaagtcaggagcaatgggatatagggcccagtgggggctgaagtgctatgttcagagtagcccttccaatgggcttcttcgtttgatggatggaaaccaaaccactccaaacacaaggtgttaactgctcctacttgggcaaagacagttatcctgtcaaggcatggtcttaggatttagggcccaccctaaatccagaacaattttattgagagatcttaacaaattatacctgccaagtccctatttccaaataagtcctgagtggggatggggtggagagaaagtggacagtgggtggtgggagatacagggagaaagaatgagaattgctcttgttctcaagggtaccgcatcacgttttcctctggctggcagtctttaacaccagcgtatcctatgagacctgacttcactcatcagctgcatcagctcagtgtcattaccacatgtagacagcaatgtaatcctccttcttagagatgctgcagcagattggagggtgaagagatgtatcagtcagatcagagtaaccagctggctcctggctcctgatcattgtcacagctcagtagctggaagctccttccatatggctgatgcctttaaaaaaatctcctcaatctccatccccatctgcaatactgtttagttattcaatcatttaagtcattcatgtattgaaaagaggatggggatatgatccctctgctctgtggcagtagatctactaatgggagagtcctggccgcacatctggcctgggtctggaggtgcctacggaattgaaagctggctggaactgtcatcttaacatgtcctggtcatcttaacgtgtccacctctctggcaagcctcttttcaagtctttttgttaccatcttcagctttttccctccatactagattcttaatgaattgctgccaacaagagaaagctttatacatgaagagaatggcaataagaactaactcgtctttttaattttaaaactggtatatattcctatataataggaatggaagatacttgcaaagcctatttgttcctctacagaagagttaaaaattacctgggctaatggaaagaagggagagtcagccaattagatgctcctgaatgccctgaattgtgacttacctcttcttatccacatcctgatcaaggaaagggatgagagagaggtggagagagaagaaatggaaattcaaaagttttgacggcagaggaaaattgtgcttatttccagaatgagacgaacaaggtcctgggtccctacatgtcatactggctagagactgggaaacagattaactgagagaagccatcaagcctgaagagacatcgtgtttgaaatgtgtaaggcacagtgtacccgccgtggatcaaaacaacctgaaggacagacagacagacacaccgaggatcagcagatatcagtggggacaggtgctgatgatggtgcaaatgagagtcatgaaggaaagttaaatgatgaccaaagaccaagtaccttccccacaatgctttgacaagcgcttttataagcaccctggaatttagacactacccggggagaaaaggaaagggagacaagcatgaattgtctgagaaacccctgaattaatcatgtgtaccccaatgcaacaaggatctagatatagaataattttaattatagaaaacaaaattatattttacccacccatatttgatgcccatgaatttcacatctaccttacgtgcacataaaattcaagcttagatagacggaaaacaaaaaatcaagaagcaatatttgccttctaataacttatctattggaggaggtaaaagatagaaaagtagttcagatgacaaatactaaaagagttaggaacttctgcttccacttacgatgaaggaacttgtactcaatccatccactttgtaattctccttgagctgctgtaataaagtaccacaaactgggtgacttaaaacaacagaatttattgtctcatggttctggagcctagaagtctaaaatcaaggtatcaacagagctatgcttcctctgaaacctggaaggaaattcttccttgcctattcctagcttctgttgatttgctggcaaattttgacattccttaacttgcagctacataactttaaactctgcctttggcattacatggcattttccctgtgtgtttctgtcttcccacggctgtcttcttacaagtacatcagtcatattaggagtccacagtgctccagtatgacctcatcttaactagtcacacttgcaatgaccctattttcaaacagagtcacattctgaggtactgagggttgggatgtcaacatatctttttctggggggatggtgggtataattcaatccattataccctccaataataaa

SEQ ID NO: 465437 - DNA, 2934 bp, Homo sapiens
tgaagggcaatggctgggctttggaaaaccagcaagatgaggacagagaggaaggcacacagcaaaccataagcccttacccagtgcaggacagaggatgctgctttctcctgttcatcctgatggaagtcctcaaacaccatttccatacccaggcattctgggtccccactggagggttagtctgaagggcaatggctgggctttggaaaaccagcaagatgaggacagagaggaaggcacacagcaaaccataagcccttacccagtgcaggacagaggatgcgggcagacctatgggttacaatgtctggtcatttcccaattccagattaaactgtcacctgttttacctttagttttattagtttgtagtcttaacacctccagcttctcttgtttcaggatttgggcttaaaattgagtgctactctgcatgtctagtttgaaatactagagaaggcagagttgagacaactgatatgtaaagcctggggaagagtgatttctcaggagcgagacacactaagtcaggagcaatgggatatagggcccagtgggggctgaagtgctatgttcagagtagcccttccaatgggcttcttcgtttgatggatggaaaccaaaccactccaaacacaaggtgttaactgctcctacttgggcaaagacagttatcctgtcaaggcatggtcttaggatttagggcccaccctaaatccagaacaattttattgagagatcttaacaaattatacctgccaagtccctatttccaaataagtcctgagtggggatggggtggagagaaagtggacagtgggtggtgggagatacagggagaaagaatgagaattgctcttgttctcaagggtaccgcatcacgttttcctctggctggcagtctttaacaccagcgtatcctatgagacctgacttcactcatcagctgcatcagctcagtgtcattaccacatgtagacagcaatgtaatcctccttcttagagatgctgcagcagattggagggtgaagagatgtatcagtcagatcagagtaaccagctggctcctggctcctgatcattgtcacagctcagtagctggaagctccttccatatggctgatgcctttaaaaaaatctcctcaatctccatccccatctgcaatactgtttagttattcaatcatttaagtcattcatgtattgaaaagaggatggggatatgatccctctgctctgtggcagtagatctactaatgggagagtcctggccgcacatctggcctgggtctggaggtgcctacggaattgaaagctggctggaactgtcatcttaacatgtcctggtcatcttaacgtgtccacctctctggcaagcctcttttcaagtctttttgttaccatcttcagctttttccctccatactagattcttaatgaattgctgccaacaagagaaagctttatacatgaagagaatggcaataagaactaactcgtctttttaattttaaaactggtatatattcctatataataggaatggaagatacttgcaaagcctatttgttcctctacagaagagttaaaaattacctgggctaatggaaagaagggagagtcagccaattagatgctcctgaatgccctgaattgtgacttacctcttcttatccacatcctgatcaaggaaagggatgagagagaggtggagagagaagaaatggaaattcaaaagttttgacggcagaggaaaattgtgcttatttccagaatgagacgaacaaggtcctgggtccctacatgtcatactggctagagactgggaaacagattaactgagagaagccatcaagcctgaagagacatcgtgtttgaaatgtgtaaggcacagtgtacccgccgtggatcaaaacaacctgaaggacagacagacagacacaccgaggatcagcagatatcagtggggacaggtgctgatgatggtgcaaatgagagtcatgaaggaaagttaaatgatgaccaaagaccaagtaccttccccacaatgctttgacaagcgcttttataagcaccctggaatttagacactacccggggagaaaaggaaagggagacaagcatgaattgtctgagaaacccctgaattaatcatgtgtaccccaatgcaacaaggatctagatatagaataattttaattatagaaaacaaaattatattttacccacccatatttgatgcccatgaatttcacatctaccttacgtgcacataaaattcaagcttagatagacggaaaacaaaaaatcaagaagcaatatttgccttctaataacttatctattggaggaggtaaaagatagaaaagtagttcagatgacaaatactaaaagagttaggaacttctgcttccacttacgatgaaggaacttgtactcaatccatccactttgtaattctccttgagctgctgtaataaagtaccacaaactgggtgacttaaaacaacagaatttattgtctcatggttctggagcctagaagtctaaaatcaaggtatcaacagagctatgcttcctctgaaacctggaaggaaattcttccttgcctattcctagcttctgttgatttgctggcaaattttgacattccttaacttgcagctacataactttaaactctgcctttggcattacatggcattttccctgtgtgtttctgtcttcccacggctgtcttcttacaagtacatcagtcatattaggagtccacagtgctccagtatgacctcatcttaactagtcacacttgcaatgaccctattttcaaacagagtcacattctgaggtactgagggttgggatgtcaacatatctttttctggggggatggtgggtataattcaatccattataccctccaataataaa

SEQ ID NO: 465438 - DNA, 5065 bp, Homo sapiens
tgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgg

SEQ ID NO: 465439 - DNA, 2068 bp, Homo sapiens
tgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgta

SEQ ID NO: 465440 - DNA, 5171 bp, Homo sapiens
tgggagtgccttcctgacctcagtctttattgatcttggtatccgcacctccagtgacgtgtcctgaagggtgggagagaattcacaagtgcctcacacacagggaaagaaggaagtccaactattgctgcagaaagtccccactggggaggtgcgggtagagtgtttgggtagcattaaaacagtgagtgccctgtgagaagcacagtgcctgggtgcagcactttgcatcagctctgattttgaaatcagacacagaaggctttgaagccggccagtaaggggttgtcaggcagttgactaatgctcttgatttgaatcggaggctgctgtgaaaagggatgcagcttctgctagccactgtgaacttctgaatctcactagggttgggtctgctttggggcactcagataaccccagtatttccaaaccagctttcccttttgcttcaggacatatcttacccaagcctgcactatggagaagtgggacggtaatgagggcacctcagcttttcacatgcctgagtggatgagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgg

SEQ ID NO: 465441 - DNA, 4931 bp, Homo sapiens
acccttaaaagtgatggcagtacttattccattgagagatacaaagcgttttctagagagtgtttcttaaccccccaaaaaacttgggggttaagaactatcttcagaagctcaaacacaaatcagggaaggacactgcttcaaataatctagcaaatggacctctgcgtgttctgaagataaagttagccctacatttcaagttaaggctatccaggaagaatgtctttggcaatctctttcagcttccctcttctggcatgtgtatagcctgcaggtacttaacagaggtaaaaaaatttatatggtgctaggtggctagagaagcttcagtttgctccatggtttggaattttagaggaagcatttttttttttccgagtgttttttattctgtcattccagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgg

SEQ ID NO: 465442 - DNA, 4212 bp, Homo sapiens
cccgggatgtgggtgagcccccgaatgacttttgaataaaatctttattgtgaagctatatatgcaggctctagaaagatattctttatttctcagtggccacctaacaggatgaaactagtcatgtctcatggtctcatgcctacccaatcaacgtatttctggggcctcctatgaaagcaatggtagattgtaatgtcctggtgttttttgttcttggcttccctcatcctcaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgg

SEQ ID NO: 465443 - DNA, 4642 bp, Homo sapiens
tgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctcacagggtcgtggtgagggcaaatagtat

SEQ ID NO: 465444 - DNA, 2608 bp, Homo sapiens
tgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgttttctagagatgagagcaactccaaggtgaacattgaaggggacagacaagttattttccctttcgaaagtttttttctcttagtttcagttgtttgaatatttaaatgcacttgaaataggtgctgagttgtagtttgtgaagaccacagtggggaagagtggtgtcctcttttttcttggtggtcaggtggtgtgtgcagtgtgcaatttccatacttccccaacctgcctggcgcccctcattacagtcagggtaatttacagaagttgaaa

SEQ ID NO: 465445 - DNA, 1501 bp, Homo sapiens
tgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatgggtaatgtttattatctttgagatgaagttgtgatgtccagttgagattctaagttttttggctttggttatttctggaaaggattcatgtagcacctctggataatgtctccataaagccagagctttgtcacctcataaattaaaattacattatttttattttctcctttgtatcttttctatttctaaatattatattttcaaaatattatctaataaatgtatgttgcttttatgtttaaaagttactgtgttatctacatcttcttcctttctgcaccacttgcaagaaa

SEQ ID NO: 465446 - DNA, 546 bp, Homo sapiens
ccatggcttgaaccacgacataatagcaacactttgggaggttggggcaggaagactgcttaggcccaggagtttgagaccaacctgggcaacatatggaaggcaccatctcatcaaaaaaaaagcgtgcttcacgaccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgg

SEQ ID NO: 465447 - DNA, 435 bp, Homo sapiens
acatagagtcagctggagcctccctcttcccatggcttcccccaatacttgccttcttagaatactgaagaggttctgtagagcccaatttgaaaatcactggcttaagtcattcccgttgtattttctgattgtaaaatatataaactttatctccttgactagttgtttggcccaggcttgctcataccctgctttgtctttaatacaggtgcttatggaaactctgggtgctctgggggcccagtgccgatgggctgcctgcaacatctattccactctcaatgaagtggctgctgctctagcagaaagtgaagtggtaagagcttattctctgtgcctttggctaaagtaagtctatttggagacttactttatgtttcagcataaatctttaaagaaggttgacaataaaagaactatcttggaagaaat

SEQ ID NO: 465448 - DNA, 444 bp, Homo sapiens
gtaaaaaaatttatatggtgctaggtggctagagaagcttcagtttgctccatggtttggaattttagaggaagcatttttttttttccgagtgttttttattctgtcattccagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaaggtaaagaaaacaagcaccttttccttcttaacctacctgtgtctttttgtccatattaatccctttttatgtctggggtctggtagcttgtgaaatttctatgtgataagaatacttataacaaaagaaatgtgagttcaagaaacactggggaaatctggcaagtctagaaggaaccctgtatt

SEQ ID NO: 465449 - DNA, 4557 bp, Homo sapiens
agaccccatagattttgagcactcccacaaaaatcgcttgaaccctggaggcagaggttgcagtaagctgagatcacaccattgctctccagcggggacaacaagagtgagactccatctcaaaacaaacaaacaaacaataaaagcacaaacagccaggcgtagtctcatgcacttgtagttctggcaggcagggagaccagtgcagatttagtgaacattgtacctagtaggtaatttttcaaccttcaacccgctcccactctcccactttttatagtctccagtgaaggccttaaaatttagaggtgggtcaaggatttcccccacatgacttttgaataaaatctttattgtgaagctatatatgcaggctctagaaagatattctttatttctcagtggccacctaacaggatgaaactagtcatgtctcatggtctcatgcctacccaatcaacgtatttctggggcctcctatgaaagcaatggtagattgtaatgtcctggtgttttttgttcttggcttccctcatcctcaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatggactcttaagggtatttcttgtttctgtgaactagaaatt

SEQ ID NO: 465450 - DNA, 2174 bp, Homo sapiens
tgggagtgccttcctgacctcagtctttattgatcttggtatccgcacctccagtgacgtgtcctgaagggtgggagagaattcacaagtgcctcacacacagggaaagaaggaagtccaactattgctgcagaaagtccccactggggaggtgcgggtagagtgtttgggtagcattaaaacagtgagtgccctgtgagaagcacagtgcctgggtgcagcactttgcatcagctctgattttgaaatcagacacagaaggctttgaagccggccagtaaggggttgtcaggcagttgactaatgctcttgatttgaatcggaggctgctgtgaaaagggatgcagcttctgctagccactgtgaacttctgaatctcactagggttgggtctgctttggggcactcagataaccccagtatttccaaaccagctttcccttttgcttcaggacatatcttacccaagcctgcactatggagaagtgggacggtaatgagggcacctcagcttttcacatgcctgagtggatgagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgta

SEQ ID NO: 465451 - DNA, 4816 bp, Homo sapiens
acccttaaaagtgatggcagtacttattccattgagagatacaaagcgttttctagagagtgtttcttaaccccccaaaaaacttgggggttaagaactatcttcagaagctcaaacacaaatcagggaaggacactgcttcaaataatctagcaaatggacctctgcgtgttctgaagataaagttagccctacatttcaagttaaggctatccaggaagaatgtctttggcaatctctttcagcttccctcttctggcatgtgtatagcctgcaggtacttaacagagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgg

SEQ ID NO: 465452 - DNA, 5071 bp, Homo sapiens
  misc_feature (4309)..(4309): n is a, c, g, or t
  misc_feature (4318)..(4319): n is a, c, g, or t
tgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctatagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagaccttttcttccttcccccccgcccctctgcccctccttccctcccccctccccccccgcgccccgccagcctttctttttcctccccncccctgccnnccccccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgg

SEQ ID NO: 465453 - DNA, 3833 bp, Homo sapiens
tgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgccttgacattctcaatggtgtcactcggctccacttcgaga

SEQ ID NO: 465454 - DNA, 3742 bp, Homo sapiens
  misc_feature (2)..(2): n is a, c, g, or t
  misc_feature (5)..(5): n is a, c, g, or t
  misc_feature (8)..(10): n is a, c, g, or t
  misc_feature (12)..(12): n is a, c, g, or t
  misc_feature (14)..(16): n is a, c, g, or t
tnccnggnnncntnnncagagagcccttcgccaaccctgggaaagccccaaacgacagctcccgagcgccacccggaccagactccaggaccgccctgtcccgccaccctttttcccgcccagactccacgtcttctgaaagagggcgtggcccgcaggaagttctcgcgttacggaaagtgaagtgtttccggctccggtgtcatggccggctcctaccctgaaggtgcacctgcaatcctcgccgataagaggcagcagttcggaagccggttcctgagcgatccggcgcgcgtcttccaccacaatgcctggtaatcaccctgccccctcgcccggcctgtcgctggccgtctgtcccgccgcctcggagcattccgaaaagcccctgaccgccggccacgagtcaagctgccctacccgaggcactctccaaggggagagaaactcctaggccagcgactcaccctgctcgcagccaggacgtgaagcccctaagctgcccgtttgattttctcagggacaatgtggagtggtcggaagagcaagccgcgcggcggagagaaaagtccaggagaacagtatccagcgggtgtgccaggagaaacaaggtgcgcttaaatgggctctcgttggtatcaacagccagcgtactgccgaacgcgccctcccggagaggccagggaaccgcggccgcccacatcctttattcctggcctgatgcggatctcaggaagccttgaacataaaacacagacacctcctgtggaggagaatgtaactcagaaaattagtgacctggaaatttgtgctgatgagtttcctggatcctcagccacctaccgaatactggagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaaaaaaaaaatgaccctgtagacagcatcaaaatgtggtgttcttgttaagtaattgatcgtggtctttgctttaatcttagttccgccaggcacggtggctcacacctgtaatcccagcactttgggaggccgaggcgggcagatcacctgaggtcaggagttcgagaccagcgtggccaacatggtgaaaccccgtctctactaaagataaaaaaattagctgggtgtgttggtgggtgcctgtaatccagctactcgggaggctgaggcaggagaatcacttgaacccaggaggcagaggttgcagtgagctgagattgcgccactgtactccagcctgggcaacaaagcaagactctgtctcaaaaaaataaaaataaaaaaaatcttagttccatggaattttaagcactgttccccctctaacctatgtctaaagaattaaaagaatttggctgggtgcggtagctcatgcctgtaatcccaacactttgggaggctgaggcaggtggatcacgaggtcaggagatcgagaccatcctggctaacacggtgaaacctcgtctccactaaaaataccaaaaaaaatagctgggcatggtggcatgcgcctgtagtcccctgtagtcccagctactcgggaggctaaggcaggagaatcgtttgaacctgggaggcagaggttgcagtgagccgagatcatgtcactgcattccagcctgggcaacagaggaagactctgtctcaaaaaaataaaagaaaagaattttcactttttgcaaaattatctttttttactgcacccttaagtgtttgacacaaaaggaattgagagaacttcttaattttaaccacatcatcacttcactctgaatgtgatcactgtcagtgttagatgctttttttttttttttttaggagacagggctctcactttgttgcccaggctggagttcagtggtgcaatgatagctcattatcacctcgaacttctggcttgagccatcgctccacctcagcctcctgagtagctaggactgcaggtgggcaccatcatgcctagctaattgttagatcctttttttttatgttctgcattttttcaattatttttacatatttctgtcttgatccatgcagttataggatatatccttaattttagaaagtaaggacttttcgaccaggcatggcggctcacgcctataatcccagcactttgggaggctgaggtgggcagatcacttgaggtcaggagttccagtccagcccggctaacatagtgaaaccccgtctccactaaaaaataaaaaatcagcccggcatggttgtgggcgcctgtaatcccagctactcaggaggctgaggtaggagaattgcttgaacctgggaggcggaggttgcagtgagctgagatggtgccattgcactccagcctgggcgacaagagcgaaactgcatctcaaaaacaaagatgcctagctttcaccttgttgatgtttttctaaattttggaataataaatttatataggaatactgcaagaatagtccatttttttctgatgtcccaacatcagcaaatatattaccaaatatatccatcacaagtaggaatacatggaaacattaatgccagccactaaccattcatgtttacccagtagtcccaatatagctctgtcacacagatacatgattaagttggctgagcacagtggctcctgtaatcttagaattttgggagcccaaggcaggaagattacttgaggccaggagtttaagaccaggctgggtaatgt

SEQ ID NO: 465455 - DNA, 432 bp, Homo sapiens
caataagagctactccagcctgggcaataagagctactccagcctgggcaataagagctactccagcctgggcgacaagagcgaaactgcatctcaaaaacaaagatgcctagctttcaccttgttgatgtttttctaaattttggaataataaatttatataggaatactgcaagaatagtccatttttttctgatgtcccaacatcagcaaatatattaccaaatatatccatcacaagtaggaatacatggaaacattaatgccagccactaaccattcatgtttacccagtagtcccaatatagctctgtcacacagatacatgattaagttggctgagcacagtggctcctgtaatcttagaattttgggagcccaaggcaggaagattacttgaggccaggagtttaagaccaggctgggtaatgt

SEQ ID NO: 465456 - DNA, 1577 bp, Homo sapiens
ccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaaaaaaaaaatgaccctgtagacagcatcaaaatgtggtgttcttgttaagtaattgatcgtggtctttgctttaatcttagttccgccaggcacggtggctcacacctgtaatcccagcactttgggaggccgaggcgggcagatcacctgaggtcaggagttcgagaccagcgtggccaacatggtgaaaccccgtctctactaaagataaaaaaattagctgggtgtgttggtgggtgcctgtaatccagctactcgggaggctgaggcaggagaatcacttgaacccaggaggcagaggttgcagtgagccgagatcatgtcactgcattccagcctgggcaacagaggaagactctgtctcaaaaaaataaaagaaaagaattttcactttttgcaaaattatctttttttactgcacccttaagtgtttgacacttgcatccgaggggatcctctgacgccacg

SEQ ID NO: 465457 - DNA, 321 bp, Homo sapiens
ggagcagagaactttcttatggcagaagcaggctgtccttgggcctcttcgggctgaaggcagtggattgaggccacagctgtgagcaggcagctaacgtccttcagttctaactgaagagtagaggagcttagatctcagacttggtgtgtcagttgaggaagtccactggctttttgggatatgctacagggaaagagaaccctgtctttaaggagacctgattaactataattccctgtgtctccacaggatgcagaaggctatcaacaggctgagcaggcttctgaaacctggggggatggtacttctgcgagatta

SEQ ID NO: 465458 - DNA, 432 bp, Homo sapiens
caggcttctgaaacctggggggatggtacttctgcgagattacggccgctatgacatggctcagcttcggtttaaaaaaggtattttgagagtgctgaatcctaaccactagagatcatgtcctttgcagggacatggatgaagctggaaatcatcattctcagcaaactaacacaagaacagaaaaccaaacaccatattttctcactcataagtgggagttgaacaatgagaacacatggacgcggggtggggggcatcacacactggggcctgtctggaggtgggggggctgggagagggagagcattagcagaaatacctaatgtagatgacgggtagataggtgcagcaaacctccatggcacgtgtatacatatgtatcaaacctgtatgttctgcacatgtaccccagaacttaaagtataattt

SEQ ID NO: 465459 - DNA, 3221 bp, Homo sapiens
ccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaaaaaaaaaatgaccctgtagacagcatcaaaatgtggtgttcttgttaagtaattgatcgtggtctttgctttaatcttagttccgccaggcacggtggctcacacctgtaatcccagcactttgggaggccgaggcgggcagatcacctgaggtcaggagttcgagaccagcgtggccaacatggtgaaaccccgtctctactaaagataaaaaaattagctgggtgtgttggtgggtgcctgtaatccagctactcgggaggctgaggcaggagaatcacttgaacccaggaggcagaggttgcagtgagctgagattgcgccactgtactccagcctgggcaacaaagcaagactctgtctcaaaaaaataaaaataaaaaaaatcttagttccatggaattttaagcactgttccccctctaacctatgtctaaagaattaaaagaatttggctgggtgcggtagctcatgcctgtaatcccaacactttgggaggctgaggcaggtggatcacgaggtcaggagatcgagaccatcctggctaacacggtgaaacctcgtctccactaaaaataccaaaaaaaatagctgggcatggtggcatgcgcctgtagtcccctgtagtcccagctactcgggaggctaaggcaggagaatcgtttgaacctgggaggcagaggttgcagtgagccgagatcatgtcactgcattccagcctgggcaacagaggaagactctgtctcaaaaaaataaaagaaaagaattttcactttttgcaaaattatctttttttactgcacccttaagtgtttgacacaaaaggaattgagagaacttcttaattttaaccacatcatcacttcactctgaatgtgatcactgtcagtgttagatgctttttttttttttttttaggagacagggctctcactttgttgcccaggctggagttcagtggtgcaatgatagctcattatcacctcgaacttctggcttgagccatcgctccacctcagcctcctgagtagctaggactgcaggtgggcaccatcatgcctagctaattgttagatcctttttttttatgttctgcattttttcaattatttttacatatttctgtcttgatccatgcagttataggatatatccttaattttagaaagtaaggacttttcgaccaggcatggcggctcacgcctataatcccagcactttgggaggctgaggtgggcagatcacttgaggtcaggagttccagtccagcccggctaacatagtgaaaccccgtctccactaaaaaataaaaaatcagcccggcatggttgtgggcgcctgtaatcccagctactcaggaggctgaggtaggagaattgcttgaacctgggaggcggaggttgcagtgagctgagatggtgccattgcactccagcctgggcgacaagagcgaaactgcatctcaaaaacaaagatgcctagctttcaccttgttgatgtttttctaaattttggaataataaatttatataggaatactgcaagaatagtccatttttttctgatgtcccaacatcagcaaatatattaccaaatatatccatcacaagtaggaatacatggaaacattaatgccagcctgaccaacgtggagaagccccgtctctactaaaaatgcaagatagccaggtgtgatggcgcatgcctgtgaccccatctacttggaaggctgaggcaggagaatcacttgaatctgggaggcagaggttgcagtgagccgagatggcgccattgcgctccagcctgggcaacaagagtgaagctccgtctcaaaaaaaaaaaaaaaaaaaaatttacggggcttgggggggggcccctgtattcccagttatctggggaggctggagtctagagaatcttttggaacctgggggaggcgggaggttgcagtgagccgaggatcggccaattggcactcaagcctggggcaacagtcgagactcggtctcaaatataaaaaaccaacaaaaattggtccacaaataattatttggttttggattcttcaacaaaaaaaaacaaaatacaatataaaacaaaaacacaagcctt

SEQ ID NO: 465460 - DNA, 1141 bp, Homo sapiens
ccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctagtttcgctcttgttgcccaggctggagtacaatggcacgatctcggctcactgcaatctccacctcccaagtttaagtgattctcctgcctcagcctcccaagtagctggaattacaggcatgcagcac

SEQ ID NO: 465461 - DNA, 1339 bp, Homo sapiens
ggtgcccaagacctaacactggagatgtcagctgtggagagtgagaagacaagcccctcagtgggacatctcacagcgctccttaagagcagcgtggccctggtccccatgatccatggaacagaggcggccccagctgtctccgcaggattatgcaccgcgcgtcatgagccgagggggacaggacccgtggagcaccactctcgaaagccctttccctggggccagatggccagcaccatggacagcagctcgccagccttcgctgagcctccaccagagaggcaaggggaggacactagggaggccaggagaggctacgggaggacgctcgggaggccacgagaggctacaggaggatgcttgggaggccatgagaggctatgggaggacgctcaggacaaggaatcacgcaagtgggaaaccgtccttgcgagcgcctcacgtgagccacagtcaccgcacaaagtctccatcgcgttggacgctggagtgacaggaaacacgttcgctcccattggaaacagcacgtgctccagcagagctcagagccccggcagcccctccatccaccgagacatacacggctggaaggacgtggtgctgcggaccatgggtggttcttctgccacatttgctgggacttgtcctaaggacattttcaatttctgaaatcagtcgccattgacggccagggttctcattcctgaatttttgtctttgcttctggttaccagagatccaaagctgcagtcgtttagctggtttctgtttccaggggtattgtgaatggaaataaaccatgaaaatgaccgaagacgtcacaaggaaagcaaataggatttaaaacagcaaagcggtgcctttgccaattccagggagtgtttctgctacataaccctgtctgtgctgggcagtgccgctcccgtgcacccaggactggaaaagcatagcttaggggttcaggggagaaacagtgacctctgcatcagaaaagtcctagataagttgccaggaaaggcaacagcacctggaatgagagacaagctcaggactcgtgccccaggctgcagggacacccacagagctgacttctcctcggtcaaccagcccccagtgctcggaagcatctggcccaggcacaagcatgctcctgctgctacggcagctgaattgggaagtatggcgggggcacagatgccccaggtggacggccaggcctctggtccacacacaggcattcactccccatgtggccatgagcccccgattctccaagtcctgtgttctcacctgtaaaatacggaagctatgctagacaactgctgacttccctcac

SEQ ID NO: 465462 - DNA, 1450 bp, Homo sapiens
gcaaaaaaaaaaaattctagatagaaacagcctcctggatccctctctcactgcggaagaaagccgccaaggagagtcacctgttcatgttggactttgtgtgcatgaaaaacaaactttcattgtgttaaaccactgagattgggatggatatttgttactgctgcatcctctaatctaatatgtcagaggactgcagccgcaccataccctgcagttctgaagccctgcagggagccccctcggcttgtcctgtggtccctttaggaaggtgggcctggctcagaagttgcatccagaggaaactgagctcctgcacctgctccacttgatgaatgacaaacagcaacagatgcgcagagcggggggaggttgaaggctttgtctgcctttgcggcccacgcacagaaagcggttcccctgccaacgaccaggtggctttgcccaaatatggagaaacactttaggccattagttctggtttgagctaagcagaataaactaatcttcccctggccaaatgggaattggctgcctgcatctctgacgttcacagtcaaggtcctctgagtccgcctgtttcacaagtacctgctaatggattcattagctatttatttttccttctctaaaaatgtaatttgtagcaaggggaaatctctggaaggacatggtaaattattaaaagcagtgatctttgagtggtgggattatgggagctttttgccccctctgggcttttttccataattgttttgtacactgtgtgtatatggatattttttttcctgtggtttggcacatgtgtacactcaacacacacacacacaacctctcccgtacccacagccagtctgagtgggagaacctgccatgggccaacacctcttctccaaccctgccccaggacagcaggttgccatacctccaaaacccgacttccagttcctgttgagatccacgccgatgcagaagattccaggtctgatggacttgttcttccgccataagcggttccctcaccatgctgtgggtaaaagcaaacccatcagggtttgtgacgagctctatgaagatgtccatggcattcagtatgtctgtcaggacacggtctttgccataatcactgacaatctgcaagaaagagtgaggagggatgggaggccctactgggtctcctgggaggtggcacaggacattttcacagccagtggctgcaggaagggatggcatgaaacccctgagggcgggatggagacagcaccctgagtgtaactgttgaactgaaggtgcccttaaatagtaagttcctgcccccagttgcagcccccatcgtgggtgcaccttggctacaggtccatgctgaccttattggcagtccagatgccggtggcatgggtgatccactcccgggagtgaattccagtgtcaatccagatggctgggtgcc

SEQ ID NO: 465463 - DNA, 725 bp, Homo sapiens
tttccaggtctttcagtcaccatgctgcttccttcagcttccttctgcataaacactcacatcatgcaggtgttgggtccagtaccagcacctctcaccagtggtctacactattatacaactttagaagaactctggaaaagttttgatctttgtgaagactattttaaacctccatttggaccatatcctgaaaagagtgggaaggattccttggtttccatgaaatgttcattgtttcggttctgtccgtggtcaaaagaattgcctttccagcctccggaggggagcatttcttcacacctaggatcaggagccagtgacagtgagaccgaagagacccggaaagcactacctatacaatcattttcacatgaaaaagagtctcaccaacacagacaacactcggtcccagtcatcagtcgcccaggttccaacgtcaaacccaccctccctccaatccctcagggccgcaggtagactagcacttgatgtctgatcctaacatggaaaacctgctctgctgatgtcgaattccttgccttacctggccatgggtccagctgtttctcactcaacccattacccacggaagaatgttctacctgccttaattctatcagccagtttctcttgtgattctttggctggtgtcttttagttttttaattaaaaaattgtttcttaaatgatttttaaagatgtgagtttttttaatgtgagtt

SEQ ID NO: 465464 - DNA, 1251 bp, Homo sapiens
ggcgccatgagtttatccagcccccccgggagtatgggcctgatggaggacaagtagggcctcgaggacaggtgcgtgacagaagcacaggaaaaaaaagaaaaatgaagaaataaaaacacgagttcatcagtaaagaggtaccctggcagcataaatattatgataagctaaaagctggaatcatctggaaaaataaataagactcctcatgtccttttcggtccataaccagaagggcagcaaaaggcctttgccactggaacctcttctttttctccaagtcccacgtagcaattacctgcactttcaagaagagaaacaacgactacacctaaagaaattccttcttgataggatgtttctagtggccaagatacaagcaaatgtagaaagaaaagatgttgctgactactatgaacaaatgtttcagtcagttttgaaacatcacctaggagaagcagtgacaggattgctgctcatctatcccacttccattctgcatatcctcgagtcctccagcgacactctctacaaagttcttttagattatattggccatgtcaaagatgaaacagtattttttattcaacaaatgaaaattatagtcatttctcataacattccaatgaggctttttatgcaatggcatgtttcagtgataaaagttccagttatgtatctcgacgatgtgacacagtcacagtccctaaaggaggtcatcacagattttctcacacaaactcataaactgtcactctacctttgccagactatgaaagtaggcactaaaggaccaggcgataacttacaccaagttgcacctgacctactcctcccagaacaaatcataaagtacttgtgcaaatccgaagaattcatggacccggcaacatttataaacatgtataatagacccatacacatcactctggattctgaggtggtatggcctgctccttcacgtttctaggattgagagggataatgtgcccatgtctcttaaggagtttgtgctacttaaataaaaaaaacatttttaaagttactggtgtcttttaaaagaaacagaacattgcaatatacacagaggtaatatattaatctttatagagtatgttgagctaaactttaaaatgtatctatttgttgtggtattaagttcaatacattattttactaggtagatgggtttaataagtttatcataagctctcaaatattaacatcattttcatgaattgacacttt

SEQ ID NO: 465465 - DNA, 928 bp, Homo sapiens
gttgtcattagcaaactggcttatttttcaaggttgaagtttcttgacaattcattcaatggtgatttaggccagtagaaataactgctctgtttctaaaaacgggcagaaaggctattgtatttggtcccgttgccgtggtagaagaccccttacctttacagtatgcactttccaggattcagcaatattatggacataactgaggagttgggtttagatatcaagtcatcagggtctggctgtgtagaagttcaaagtattgagggtgataattgcaaaattgaaacagagcatgggactagcatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatgggttgctgaaagccaagtatctttatacagaatcatcatttctgtcttctgctgctggggatattacattaggaagtgttcatggtaagctgacaaaggcgtaatacatctgagactttccacgtagcataaattttaagagatgactctgtagttgaaaaaaggatcaggaaactggccttttaaataatgaaatgcagactaaccatctttttaaaaaaaaaaccataaaaataaaatgactcataaagctaattttattttatttgtgcaagagattaaagattatgctgttatatatggaactaataaattagtcttttttcctatatacatttttacctgttttatacctctgagttcttgatcagagcctttgatcatactgatcatactgtttatattctgcctgaaatgcttttcctagctttttaaaaatcttggtgacttttttaa

SEQ ID NO: 465466 - DNA, 591 bp, Homo sapiens
gttgtcattagcaaactggcttatttttcaaggttgaagtttcttgacaattcattcaatggtgatttaggccagtagaaataactgctctgtttctaaaaacgggcagaaaggctattgtatttggtcccgttgccgtggtagaagaccccttacctttacagtatgcactttccaggattcagcaatattatggacataactgaggagttgggtttagatatcaagtcatcagggtctggctgtgtagaagttcaaagtattgagggtgataattgcaaaattgaaacagagcatgggactagcatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatgggttgctgaaagccaagtatctttatacagaatcatcatttctgtcttctgctgctggggatattacattaggaagtgttcatggttgaatttcccgtcgacgcggccgccaatttaat

SEQ ID NO: 465467 - DNA, 3259 bp, Homo sapiens
ttctacaacttcctcttcccttttgtttctctggccctggggatagtaactgcatcctgcagcaaatacctaaagatgatgaggaagacatcacacatatcaggggaaagagtgtttttggcagagaagacagcaagtataaaggccctaaggcaagaacatgcctgctgtgttcaagaaatgaaagaatgccaggacccagacttgcttcacaattggccggatgctttcacccttcgtggtaataatgcttccaaagttgcaaatccattctggaatcaactgtctgcttctaacccatttttggatgacataactcaactaagaaataacaggaagagaaataatatttccatcttaaaggaagatccttttcttttctgtagagaaatagaaaatggaaattcttttgattcctccggtgatgaacttgatgtgcatcagttacttaggcagacttcctcaagaaattctggaagatctaaaagtgtttcagaacttctggacattttagacgacacagcacatgcccatcagagtatacataactctgaccagatcctactacacgacttagagtggcttaaaaatgatcgggaggcttataaaatggcttggttaagtcaacgccagctggcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatcatgttaggcaacctcaatacaatggaagcccttttgctggagatgaaaattggggctgaagtaagaaaggatcctttcagccaagtcatgacagaaatggtgtgtttacacagcttgggtaaagaaggcccttttaaagttttaagcaactgctacatttataaagacaccatccaagtcaagctaatcgacttgagtcaggtaatgtatctagtggttgctgcacaagctaaagctcttccgtcaccagctgccaccatttgggattatatccacaaaaccacctcaattggaatttatggacccaaatatatccatcccagttttactgttgttttaacagtttgtggacacaattatatgccaggacagcttacaatttctgatattaagaagggtggaaaaaacatatctccagttgtgtttcagctctgggggaagcagtcatttttacttgacaagccacaagatttaagtatttctattttttcctgtgatcctgattttgaagtaaagacagaaggagaaaggaaagaaattaaacaaaagcagttggaagcaggtgaagtagttcatcaacaatttttattttctttagttgagcacagagagatgcacttgtttgatttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctgaaggcagtgctaagacaaagcaagattgattacttccttgaatatttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgcctttaaaaaaattgacttatatctactcagttgtattaaccttggtgtcagaaaaagtttatgattggaaagttttagctgatgtcctgggttactcacatctgtccctggaagattttgatcaaattcaagcagacaaagaatcagagaaagtttcttatgttataaagaagttaaaggaagattgccacacagagagaaatacaaggaagtttctgtatgaacttattgtggctcttctgaaaatggattgccaagagttagtcgcacgtctcatccaagaagctgctgttctgacttcagctgtcaagcttggaaaaggctggagggaactagctgaaaagttagtacgactcacaaagcaacaaatggaggcatatgaaattcctcatcgaggaaacactggagatgttgctgttgagatgatgtggaaacctgcctatgattttctgtatacctggagtgctcactatggaaataactacagagatgtgttacaagaccttcagtcagctttggacagaatgaaaaaccctgtgactaaacactggagagaattaactggagttttaatactagtaaattctttggaggttttgagagtaactgcattctccacttctgaggaagtatagaaacaaagcgtgtgtttttgatgggagggaaaatgaggtaatggtgtgtgtgtgtgtgtgtctgtgtgtgtctgtgtgtgtctctgtgtgtctgtgtgtgtgtgtctgtgtgtgtgtgtctgtgtgtgtgtgtgtgtgtgtgtaggaaagaaagaatctcagaaaagcattatattaattttcttcatgctcaaaaccagtttttttttcctgatgaaagcacagcctaactgataaccaagatgggttttatcctcaaatatgtatttttgtgagcccatgatcattttttccttaatatatagttcctgtttaatgtttgttcaactatattcataatttgctgtacatagagaaatgctctttgggatgaaattggatattaggtttttcaaggttgaatggaacggtgtgggttgtggcaaaataagagattagtgatcaaggttatttaaaagaggaagataagtaagtacttgatattacattcctaaatctattttcaagtgatttcactgatagtttagaagaaaaaggaaaatcaaatatcctttcacgctgttagaaaagctctatatttctttctattttgattgctgagaagttactgtatgcttaggaataagag

SEQ ID NO: 465468 - DNA, 2060 bp, Homo sapiens
ttctacaacttcctcttcccttttgtttctctggccctggggatagtaactgcatcctgcagcaaatacctaaagatgatgaggaagacatcacacatatcaggggaaagagtgtttttggcagagaagacagcaagtataaaggccctaaggcaagaacatgcctgctgtgttcaagaaatgaaagaatgccaggacccagacttgcttcacaattggccggatgctttcacccttcgtggtaataatgcttccaaagttgcaaatccattctggaatcaactgtctgcttctaacccatttttggatgacataactcaactaagaaataacaggaagagaaataatatttccatcttaaaggaagatccttttcttttctgtagagaaatagaaaatggaaattcttttgattcctccggtgatgaacttgatgtgcatcagttacttaggcagacttcctcaagaaattctggaagatctaaaagtgtttcagaacttctggacattttagacgacacagcacatgcccatcagagtatacataactctgaccagatcctactacacgacttagagtggcttaaaaatgatcgggaggcttataaaatggcttggttaagtcaacgccagctggcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatcatgttaggcaacctcaatacaatggaagcccttttgctggagatgaaaattggggctgaagtaagaaaggatcctttcagccaagtcatgacagaaatggtgtgtttacacagcttgggtaaagaaggcccttttaaagttttaagcaactgctacatttataaagacaccatccaagtcaagctaatcgacttgagtcaggtaatgtatctagtggttgctgcacaagctaaagctcttccgtcaccagctgccaccatttgggattatatccacaaaaccacctcaattggaatttatggacccaaatatatccatcccagttttactgttgttttaacagtttgtggacacaattatatgccaggacagcttacaatttctgatattaagaagggtggaaaaaacatatctccagttgtgtttcagctctgggggaagcagtcatttttacttgacaagccacaagatttaagtatttctattttttcctgtgatcctgattttgaagtaaagacagaaggagaaaggaaagaaattaaacaaaagcagttggaagcaggtgaagtagttcatcaacaatttttattttctttagttgagcacagagagatgcacttgtttgatttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctgaaggcagtgctaagacaaagcaagattgattacttccttgaatatttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgcctttaaaaaaattgacttatatctatcaggaggctgaggcaggagaatggcgtgaacccgggag

SEQ ID NO: 465469 - DNA, 486 bp, Homo sapiens
tcaaattcaagcagacaaagaatcagagaaagtttcttatgttataaagaagttaaaggaagattgccacacagagagaaatacaaggaagtttctgtatgaacttattgtggtgagtattgcttgatcatggtaatgaattgccatcgagaattgtattaacttgacaatatttataactgaacatgtgagaggagaaatgtttaaaaattcaacagtcttaaatacattaaagacactttatagcaaatatagtttttcctacatgatcataaaactggtttcttaaacttgagattcaactgtgatttccccaaaaaccaggatcatcttttaaaagaaaataaaaagttctgtttgtgctgggcttaacagttcagatacaacttctcttcctgtctcaaatatttagacaactcttaagataccagagaggctccataacatgaaagcaaactaaagagaactaacttggccattgttagg

SEQ ID NO: 465470 - DNA, 468 bp, Homo sapiens
tgtttaggttacgagtcgtatgattcagaccgggttcgggatcggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagagaaggcagggactgctatgaagaccaatatgacagacgggatgatcgacccaaactgaatctaaagcctcggagtactcctaaggaagatgattcctctgctagtaactcccagtccactcgagctgcttctatctttggaggggcaaagcctgttgacacagctgctagagaaagagaagtagaagaacggctacgaaggaacaagagaagttgcagcgtcagctggatgggccaaaactagaacgacggcctc

SEQ ID NO: 465471 - DNA, 1287 bp, Homo sapiens
tccttgctcaagttgcccttggcttgctgtgatggtttggcatctgccatgtggaagatggctagttctgcacctgtctgtgcccccacagactggttccttgaacacaagcaccgagctatcatgacagtcgatctaataactgagatacctacaaaatggcttagagcaggtagcatctacggcatggatcagctggacaaagggatgattcccaatccagactttctggctgaggatgggggtactggtggaggaagcacctatgtttccaaaccagtcagctgggctgatgaaacggatgacctggaaggagatgtttctacaacttggcacagtaacgatgacgatgtgtacagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggctgaaaggttttggttatgctgaatttgaggacctggattccctgctcagtgccctgagtctcaatgaagagtctctaagtaacaggagaattcgagtggacgttgctgatcaagcactggataaagacagggatgatcctccttttggccgtgatagaaatcgggattctgacaaaacagatacagactggagggctcgtcctgctacagacacctttgatgactacccacctagaagaggtgatgatagctttggagacaagtatcgagatcgttatgattcagaccggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagagaaggcagggactgctatgaagaccaatatgacagacgggatgatcgacccaaactgaatctaaagcctcggagtactcctaaggaagatgattcctctgctagtaactcccagtccactcgagctgcttctatctttggaggggcaaagcctgttgacacagctgctagagaaagagaagtagaagaacggctacgaaggaacaagagaagttgcagcgtcagctggatgggccaaaactagaacgacggcctc

SEQ ID NO: 465472 - DNA, 504 bp, Homo sapiens
agggcctccctgcagcacagaatgggcctcaacgcgtggtgtcagctgaaaattcactgatccctgagccctctgcctccctccccctttgaaagagcagcggcctgccccgcttctaaaagccctggggctcctccaagccaacactgctttccaggacatgtgcaaacaaagacagaggcgattccgaggtgaggccaatgcgatcaagcgtggcactggcgtatcccagagcagatggtgtgaatgtgtgtcaccggaggcatatggggcgatggcaaaaccaacaatggtgtccaggcatgtgtctggtggaagggcagatcaagtgacctttccatcaatgctaaggaaaatcaaagaacatctgggaaccaggagggggcctgtgcctgagtccaagccacattttgaaatgcctgccggaggactaaagaggtttctgcaaaattcaccccacccccaaccctccacggccaaggtagccctgacccaaccttccct

SEQ ID NO: 465473 - DNA, 1190 bp, Homo sapiens
agggcctccctgcagcacagaatgggcctcaacgcgtggtgtcagctgaaaattcactgatccctgagccctctgcctccctccccctttgaaagagcagcggcctgccccgcttctaaaagccctggggctcctccaagccaacactgctttccaggacatgtgcaaacaaagacagaggcgattccgaggttggaaactctctttttgtacaattgatgaggagatatctcaaagcccattgattcaggcttatagtgaaaaatctaaaatcctaaaaaaaactataaagaagctatctctgaaaatgctttaagatgtgtgatttcatctcatagagttaaatctttctctttattcagcaggattgtgggaatatcccatagagccctcagagtagacaggtgagagttcaatgctgacacacatccacagaggactccttctccgccaagatgaagggacttgtcaccagacaatggtggcttcactgtgacaaaaaggctgcctgcagcaacccactgcagcatgctaatagtctcgaacatagagccttcatgagccatctccgtggtagggtctcacaggagaaggaggagtttcaagactgtgaggtgggctctggagactgctcttctgactccattcccaaaagaggctgtgtgcatgaattgggtctcctggggatgggaataaagtctgaatcgtcctccacgaactgggaaacttttagtgtggaagactttgagccagacccagaaaaaccccaggttcatgaggaacatggaagtcagactgagccagacctaggaaactctaggcccacaaggaacatggaagtcaggaaaagaggaggccagtgtggaggccacatccaacccagcatcaatccatctcactcccatgtggctccaggaatgaaagctcaattctggagctggccagaagggctccagtttgcaatccaacttttccctgcacgattgagtcatcccacctgggcaccaggccatgctgttgactgtgcaatgaagggaattaggggatgcagttggaagcaacttctgtgtcatctatctgcaccttttttgcaggtgaaggtgcgagatcccatccacacctcaacagattctatcctcacccctatctgaccttattgttgctcacactctgtgtcccagaataaaatt

SEQ ID NO: 465474 - DNA, 1863 bp, Homo sapiens
aattcatggttgagaatgagaatgaaccacatcaaatcgataagcccagaatctgggggtagggtagggcctacggaaagccataatgatgtaggaggacaacgcagcctgataaacaagtggacgacttttcttaaggccagactgatttgctcaattcctggaagtgatggggcagatacttactttgatgagcttcaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacagacattggaactgtcctcaaagttgtcagcatttcaaaggaaaagtggaatatggaagaggtagtgctggaggagttgcagatattcaagcaacaattgtacattggttcccgagatggattggttcagctctccttgcacagatgcgacacttatgggaaagcttgcgcagactgttgtcttgccagagacccctactgtgcctgggatggaaatgcatgctctcgatatgctcctacttctaaaaggagagctagacgccaagatgtaaaatatggcgacccaatcacccagtgctgggacatcgaagacagcattagtcatgaaactgctgatgaaaaggtgatttttggcattgaatttaactcaacctttctggaatgtatacctaaatcccaacaagcaactattaaatggtatatccagaggtcaggggatgagcatcgagaggagttgaagcccgatgaaagaatcatcaaaacggaatatgggctactgattcgaagtttgcagaagaaggattctgggatgtattactgcaaagcccaggagcacactttcatccacaccatagtgaagctgactttgaatgtcattgagaatgaacagatggaaaatacccagagggcagagcatgaggaggggaaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctacttaatttaaagaaaagaattccttacctataaaaacattgccttctgttttgtatatcccttatagtaattcataaatgcttcccatggagttttgctaaggcacaagacaataatctgaataagacaatatgtgatgaatataagaaagggcaaaaaattcatttgaaccagttttccaagaacaaatcttgcacaagcaaagtataagaattatcctaaaaatagggggtttacagttgtaaatgttttatgttttgagttttggaatttattgtcatgtaaatagttgagctaagcaagccccgaatttgatagtgtataaggtgctttattccctc

SEQ ID NO: 465475 - DNA, 3330 bp, Homo sapiens
cccagccaggggacagcctctggggacacgatgagagttcattgctcgggggacaagccaggcactggggctgggagaaaggcaggctgctgaggaccggacaggcacagaagcccgcccagcacctgggccagtggcaaggctgtccttcggctgagaagatgggcttgcttccccttcaccctttgccaggattgtaagtttcctgaggcttctgtacagcctgcagaactatgagcatgcagaggtcaggacaagagcagctggtccagccacactgtgtgcacagggacaggcctgtcttcacctgtgctcaccggggcctcttccagaggtctctgcagcagaaagcatgtgctccacgtaccggcccccagcgtcccaccagaccagcgccgatccctgtgggagctgaagaggaactgtgctgaatgagaacatttaaagtgaatcatgtgtggactccctatgctccctgactccttgtttatttctaccttttctggcggatgctattaataaaatgctaggaaaatctttaaacatgacatgagtcaagggtacagagctctcagttcaggccctcagtgcctaagaagcaaattttatttgttttttagaatgccacgtagttttctatttcaagctccccttctctcaaggcagataaaactctgcttccaatcatgaagatgccctcctttgccccctggtgtattgacgagattcgagggcagggctctggatccctccaggacaacgctcttgaaactcaaaacccagaaacggtggcccacacacttctttaaatatttttttcttggtgtaataaccctgaggcagaaaatgccaaatgacccgatagggcttgaacaacagcgagaagacagacagacagcagtgcagagcaagaggcacagtgcagcgtgccacaccagccgagaaagacagacagacagcagcacagagcaggggctcagtgtgtgccacagcagctgagacagactaacagaagcacagagcagacgctcagcttgtgccacaccagccaagacagacagcagcacaaagcaggagctcagcgtgtgctacaccagccaagaaagacagacagacagacagacagcagcacagagcaggggctcagcgcatgccacaccagccgagaaagacagacagacagacagcagcacagagcaggggctcagcgcgtgtcacaccagctgagaaagacatgtggagacttagcaggctgatctcggactgtgaaaaacctcagaaaggactttggggatcacctaatcaaggccagcagagtagtgccagaagcgcccgcagcccctcctgcagcctggcagacactgctaagatatcaccgcgttctttcccatggggcttgaacctggcctcagatgccttctcagtggtcctctgcatggcataatcatccctgccagctagcccccaagagggcccctgagctggccccaccaggccacacagcagctggccccaaggggcaggtctgtaggtctccgccctgctcttctcaccaacactgggggctgtcctccgtcccacgtgagcagaggccaggagcagaggaggctagtgaggaggtgatgcaagcaggtcctggaagaattccccagagcccgcatggcagaagacatcaggtctgtgtccagtggaagagccactgcaatggcccatccagatatgcctttgcctggtcccgtgggtcccagagccgtgctgacccacagcaggccaggaaagccccagagaatcacaaggctctgagtggctcctcctactctgagaccacccccccgcaaacccgtcccctacaccccacacatccctccatactggcccatcaagggttggtgccctggtgactgcaggagccctctgtggccagctcccctgctgccccaatcacggggtctggcccctgtcccttacctccaccagcaggaagcagctgagactcccaggcactggccgttagcatcccatggcaggcatctttgacagcagatatgcacgcatatacagcgatgtcgtatacacacgcaaaacacggcaggctgtccctgacaagggcgggcagctggggtgtgaggaagaatttgagaagaaccttaaaaagggggtgggtggagaccagggaagctgtcggcagcccctggccggatcaacatggcagccctctggtgcttctgcagggctcaaacatctgagcaagaagagagcagcttgtggaccaccatatgctagtcttgaaccacgtctaggatgggaggtccgagggacgagggccatggctgatgagggatgcttcccacagtgctgtgcagatccctgtcggcaaagttctcaggtatgcaccatgcagacatggtgttctgtgagtccacagccaagacgctgagtcacagaagactcgagagttccgcccagatcatgtgggtggcttgctttggagggagcagccaccatgccaggaggatgctcaagcagccccaaggagaaggccatgcagagaggacggaagcagccagtgacaacttgccagacacaggttgcgcccctttggaaatggattctccagcccctattgggcctttggatgatgtagcctcagctgatatctgactggaactgtatgaaaggcttcacatgacaacggtccggtcaggtccttctgaaatgcctgacccacagagacactgtgagatgaaagagtccaagacacacttatccatcacagcgatcatgcctgtaagaaaactcttcttactgcactcctacctggaactgaaagatgatgtgttcggcttcaatagatcctgctcgtcacatcagggacagtagtcaatacttttgtatttggacactgggaatcaaggcagaagatctaacagaagatacaaaataattataatacattaattacaatagcaccatgaacacagtgttgcgctttctctgttctctctggctgcagccaggaaaggactcagaccaagaagaactgctggtgtgaggacgtggccgtgctggcctcatgcagtccttcctgcattcattagttgagcaatgcagaatctgtattgacgtgaagttcaagacaaaataaataaagatacatttgtaaattcaaatataattcttcattcactttactaaaaccaagacagaaagtctgttttttacacaaagaattcatcttagcaataacacgctatgtgaacaacaacaatgaaaattctttctggcagcattggtagaaaaaaattaataaagtatagaatcttggtaatc

SEQ ID NO: 465476 - DNA, 695 bp, Homo sapiens
tgatcgagccggtaccctcgcgacgtgttatccctcgcgaacgtgttatcctgagagactttctccaagataaatctctcaaggataacctattttccatcattataattagtaaaaattagaaattttagaaagtcaattggaagccctgtcctgccagtttcttaaatcacaatgtggcctttgtacgattttacttggattttctttttggaatctgttgactgcttggatataaaatgtggggttttgacaaatttttgcaagttttcagctattagttgttacttttgcaccccatttaatttttctgtcccttcactctttctaggacacaatctgcccacagattgtaagactctgttcattttcttcaaactttttttactctttttttcagattgaataatttcaattgttctgtctttttctaatctatgaatcaacctaaaagtactatttaaaatttcattatctttctatttggttctttttaataatgtgcatttctctgctgagattccacatgtattcattcattatgagaattttttttcttcaccccatgactatagttttaatagctgctctcaaatacttgactgctgataacaacatcttggacattttggggatagcttttaatgcctattttatcttgtgtatggatacacttcgcgaggtaccttctcatg

SEQ ID NO: 465477 - DNA, 1889 bp, Homo sapiens
gcacagcttcaattctgtgcagggaggatgcagcaggagagaatatcctgggcacatctttctggagaatcacttttactacaagatttgtaagaaacaaatttatttccaagcccctgggaaacactctcctacttggtgttttctatgactttaactactcttaagtaccacatatgagaagaatcatatagtaaagaaatcatgaggaagaatgataaaaaatgtatcacatgcttattaattttcaataaaaacaccaacagagatcagtagtacctgttgattataaataaacagataaatgagaaaaaggaattggcagtgtgcattgtatttatgacaatggggcctcaagtaccatagcagtgagtcctctgccccaggcacagggctggtcagtggtggagctggaagcccagtgtagctgtctgacacccggatcccatgcctaacccaaatgtcactgagccctaaggcacttcgctcctgctggtccaggcagtgtcccctaagattcatcatggcatgttctccatggccttaaggagttgctggcctactgggataagcgatccagctggcaggacaggttgtagctacaagtcatagaggcagatgtgaggtctctatgtaggagtcacacccctagtctccttcccagtgcctgcccagctggagtgctgggcccccggggtcaccatgcagcagggcctgacactgaccagggagccatggccacaggctcttggcagctggcccaaaataaatattctccataacctctgccgatctgctggaccctcacctctcagtctcactgagccactccgttaactggaggcagacccaaaattgctccacaggctgaaggtgataattgtctacagccagctgaagcagctgcatctcctggagaactttgatctcctgcagctaaagggggggacaagtggaagatgcggataggagggtccaggagacaggggattatgagatttcaggggacaggcctcgaagggacacccaaaatgatgaagctgcagagctgtctgcttgcaaagcccagtgaggttttgcctgagctggactcagactctccctcagatggtgccaatggaaggatagtaaacttaggcctctccaagggcaggcagctcccaatcagtggcgccagcgtgaaactgtccaatcaagtgcgcagctacagaggaagaggcggcctcttcaatatggcggggcctttgtctcctagcttccgggctctgatcctagactacactaagtcagacccaaagccagcacaggactggctctcacataaggcccacagtgaccactacctagctactactgatgttcactcaagacccaagttctcttcagagtctctccacatggctgcagcagcttggattgcactgtactgggtctcacccgccgaagggctgcagcaagttactgcttactggttactgctgatgtttattcaaggcccaagggctctttactcagcaggtgatgaatgctgccagaactggtaccttcccttcaaggcagtgtgttctcttctggcccaggccatgttgtttgaattaagtgccacatatgaggctaaggtgagcccggggtcaatcacgagcgctttcagatacattcacgagaggcatattctcaagaaacaggtgtaatttgtgcagataatcacacctgggaagggatcacagagaaggagaaaaagaaagaaatggcttattctgaggtgaatgtgtctcaggtcagagactgtccaactttttcttctgaaatatcatgtgtgtagaacttgcaaatgtttacttctctactgtcggggaacctgcccccagtctttctattttccataagtg

SEQ ID NO: 465478 - DNA, 636 bp, Homo sapiens
gatagatttggcagtagtctgttaaggatgtcgtgttgggatattataattagtaaaaattagaaattttagaaagtcaattggaagccctgtcctgccagtttcttaaatcacaatgtggcctttgtacgattttacttggattttctttttggaatctgttgactgcttggatataaaatgtggggttttgacaaatttttgcaagttttcagctattagttgttacttttgcaccccatttaatttttctgtcccttcactctttctaggacacaatctgcccacagattgtaagactctgttcattttcttcaaactttttttactctttttttcagattgaataatttcaattgttctgtctttttctaatctatgaatcaacctaaaagtactatttaaaatttcattatctttctatttggttctttttaataatgtgcatttctctgctgagattccacatgtattcattcattatgagaattttttttcttcaccccatgactatagttttaatagctgctctcaaatacttgactgctgataacaacatcttggacattttggggatagcttttaatgcctattttatcttgtgtatggatacacttcgcgaggtaccttctcatg

SEQ ID NO: 465479 - DNA, 253 bp, Homo sapiens
atctttctggagaatcacttttactacaagatttgtaagaaacaaatttatttccaaggtaagaaattaaaactctaaaacaaggctagaaagtcatctgcctttaataacccttagtcatctgtgcctgatatgtgagactttctccaagataaatctctcaaggataacctattttccatcattataattagtaaaaattagaaattttagaaagtcaattggaagccctgtcctgccagtttcttaaatc

SEQ ID NO: 465480 - DNA, 3486 bp, Homo sapiens
ctaattaaatccaatgctacagatcctgggccacatcctttctacacagacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagcccccctggaggacacagtccactacagtactgcccacccctttatgcccacttctcagctgccctaaggataggcactggcatccaggtttcttttgaaaggttacacaagatgaagctcctaggccctccctgtcagcagtcctgtgccctccctctcagcagtcctgtgtcctccctgtcagtggtccttggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaagaacggaatatggtgacagctttggtgctatgtaacagcctgaggctctactgcatgctcactttcctgggggttcttgccactctgttcatctggaggcctgagctgccgccacacacagcagtgcccacatgcaggcttctcttcgtgccagcctttgccgagctgcagacggacatccatgagctgaccagtgacctggatggagccgggattccgttcctggactatagaacttacaccatgcgggtgctgttcccaggaattgaagaccaccctgtcctccgggaccttgaggtcccgggctaccggcaggagcgtgtggagaaaggcctgaagctcttcgcccagctcatcaacaacaaggtgttcctgctgtccttcatccgcacgcttgagtcccagcgtagcttctccatgcgcgaccgtggcaacgtggcctcactcatcatgaccgtgctgcagagcaagctggagtacgccactgatgtgctgaagcagctgctggccgacctcattgacaagaacctggagagcaagaaccaccctaagctgctgctcaggagcccacgggctctgaccagctgcttctttctttgtcttgttccgttggttccctcggtgactgctgacaggactgagtcagtggctgagaagatgctgaccaattggtttactttcctcctctacaagttcctcaaggagtgtgctggggagcccctcttctccctgttctgtgccatcaagcagcagatggagaagggccccattgacgccatcacgggcgaggcccgctactccttgagcgaggacaagctcatccgccagcagattgactacaaaaccctggtcctgagctgtgtcagcccagacaatgccaacagccccgaggtcccagtaaagatcctcaactgtgacaccatcactcaggtcaaggagaagattctggatgccatcttcaagaatgtgccttgctcccaccggcccaaagctgcagatatggatctggagtggcgacaaggaagtggggcaaggatgatcttgcaggatgaagacatcaccaccaagattgagaatgattggaagcgactgaacacactggcccactaccaggtgccagatggttccgtggtggcattagtgtccaagcaggtgacagcctataacgcagtgaacaactccaccgtctccaggacctcagcaagtaaatatgaaaacatgatccggtacacgggcagccccgacagcctccgctcacggacacctatgatcactcctgacctggagagtggagtcaagatgtggcacctagtgaagaaccacgagcacggagaccagaaggagggggaccgggggagcaagatggtgtctgaaatctacctgacccgactcctggccactaagaactacgtgagtcgagctgtgtctggacgtatcctgcctctccagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtggagaggtattactcagacatagggaagatgccagccatcagcgaccaagacatgaacgcatacctggctgagcagtcccggatgcacatgaatgagttcaacaccatgagtgcactctcagagatcttctcctatgtgggcaaatacagcgaggagatccttggacctctggaccacgatgaccagtgtgggaagcagaaactggcctacaaactagaacaagtcataaccctcatgagcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttcc

SEQ ID NO: 465481 - DNA, 3806 bp, Homo sapiens
  misc_feature (1)..(1): n is a, c, g, or t
  misc_feature (11)..(11): n is a, c, g, or t
  misc_feature (19)..(20): n is a, c, g, or t
ntgtaaaagtnattttganngagaaaaataagcctgtcctcattagtttattatgctaatcaaaatgaacatgaatgtaacaataactacaaatttaaccaacaattttccttacttacatttgcaaaaatcatcaatacaattttagccatttggctatttattttggccacctggccatcactggtatggttaaataatgacagagcatggtaaagtggagtttattgcaataataaaaggataattccatactagaaaacctatcattttcacaaagtaattttaaagattaaaaaaatcacattaatagacctttgaaaaaacattttcatataatttaaatctttaaaaataatataaaatctttaaaaatcataccaaattgtggggactaattcttcttaatcaataaaatctcaacaatatattcagcagttaacaaaagaaccatttccactaaaggatcgggcaggtcccctaccccagtctcggactcagggtcctgtctgaggcggccaccccgaagcgtggggtttgcggagacgtagggcctggcggagggaaggatggggaagcatctcagggaggactggcgtctgccgaatcccagggctgccctgaggggccaagaggggcgagggtggggacgatggaagacaagccacatgccgaatcgggacctgaggccgcgcgcgataggatgggcggacggcttcggagcatttccgggcgtcgcgggactccccgccgacaggagggcggttgccgagcctgtgacatccgcggagaccagcagaccccgggtgtggaggacgccgcaggaagggaactgcgtggctgggtttggccacaaaaagcggagggcactcacccgagcggacctcggctccggagaatccgtttccgggtcaacaaaaaacgtcgcgcgaggggcggggcccgtacgtgcagggaggggaggcagagaaaaaggcggggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgtgccgtgggtccgcgctgcttccacccaacttcctgttaggacccacccgaggacgggtcaccatggctttggagcacctggtagtgtggcatgtccacagtgaagaccagagtttcgttgtccttaagactgacctggggagacgtggctgcaggccattgaggaagacggcaccgaaagcgaaggaagctcctgctcctcctaaagccgaagccaaagtgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcaatgggccggaagaagatagaagaaaacaacatgcttgtgttcttcgtggatgttaaagccaacaagcaccagatcaaacaggctgtgaagaagctctatgacagtgatgtggccaaggtcaccaccctgatttttcctgataaagagaacaaggcatatgttcgactggctcctgattatgaagctttggatgttgcaacaaaattgggatcgtctaaactgagtccagctggctgactctaaatacatgtgtatcttttcaccataaaagaataatgtttttcataagagtgacaacttaattagaatcaaatctataagctttaagattttacatttctctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccgtcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacacagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaagctggcaatgtcacatttctctgaccattctttcattgtcacatctctctctggactcagctaagaaaggttctccatttttaagaactcatgtgattagactgggcccatctgggtaacccaggaagatctctccatctcagtttgcatccttaatcacatctgataagcctttattgcattcggtgtaacatattcacaggttccagggttaggcatgggcatctttgagggccattattctccctaccacattatttgcctagcatctttcattacattgtccatctatttacttactgatttctaatgacatccaaatcagttacaacattttatgtaagcattgtttttatttttatgttattccactagtctatttttctactcatcagttatggtacatgagtttatttttgcaactttaagctcaataacatgttttaagatttcctcaactttctttttgcgcttcttcagaagttgactcttttggccctttggtcttctatacacattttagaaatgctttgttgaggactaagaggaatgctaagattttgataggaatttcattgaattttgagtatattggcatgctacaatggttagtgctttatacatgaaaataatatatcccttcctcttttcctagtatcatgagatgtttgttaggcagacatgaatattgagttgtatcaaatgtggttttctgcattattgtggtggtgatgtgatttagctcctttaattagttaatgtaatgaattacatttgtagattgctctaactattgaaacaagcttgaatttctggaataagcccaatgtgatatttattcaacaaatattcattgagtatacctagtatgtaacatgctttaagaatacaccagtgaaccaaacagaaatatctgacattacagaacttaacattccagtatttggagacagac

SEQ ID NO: 465482 - DNA, 3910 bp, Homo sapiens
  misc_feature (1)..(1): n is a, c, g, or t
  misc_feature (11)..(11): n is a, c, g, or t
  misc_feature (19)..(20): n is a, c, g, or t
ntgtaaaagtnattttganngagaaaaataagcctgtcctcattagtttattatgctaatcaaaatgaacatgaatgtaacaataactacaaatttaaccaacaattttccttacttacatttgcaaaaatcatcaatacaattttagccatttggctatttattttggccacctggccatcactggtatggttaaataatgacagagcatggtaaagtggagtttattgcaataataaaaggataattccatactagaaaacctatcattttcacaaagtaattttaaagattaaaaaaatcacattaatagacctttgaaaaaacattttcatataatttaaatctttaaaaataatataaaatctttaaaaatcataccaaattgtggggactaattcttcttaatcaataaaatctcaacaatatattcagcagttaacaaaagaaccatttccactaaaggatcgggcaggtcccctaccccagtctcggactcagggtcctgtctgaggcggccaccccgaagcgtggggtttgcggagacgtagggcctggcggagggaaggatggggaagcatctcagggaggactggcgtctgccgaatcccagggctgccctgaggggccaagaggggcgagggtggggacgatggaagacaagccacatgccgaatcgggacctgaggccgcgcgcgataggatgggcggacggcttcggagcatttccgggcgtcgcgggactccccgccgacaggagggcggttgccgagcctgtgacatccgcggagaccagcagaccccgggtgtggaggacgccgcaggaagggaactgcgtggctgggtttggccacaaaaagcggagggcactcacccgagcggacctcggctccggagaatccgtttccgggtcaacaaaaaacgtcgcgcgaggggcggggcccgtacgtgcagggaggggaggcagagaaaaaggcggggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgtgccgtgggtccgcgctgcttccacccaacttcctgttagagtttctctcctgtcacaatggcatggtctcgcctcactgcgacctctgcttcctgggttcaaggattctcctgcctcagtctcccaagtagctgggattacaggacccacccgaggacgggtcaccatggctttggagcacctggtagtgtggcatgtccacagtgaagaccagagtttcgttgtccttaagactgacctggggagacgtggctgcaggccattgaggaagacggcaccgaaagcgaaggaagctcctgctcctcctaaagccgaagccaaagtgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcaatgggccggaagaagatagaagaaaacaacatgcttgtgttcttcgtggatgttaaagccaacaagcaccagatcaaacaggctgtgaagaagctctatgacagtgatgtggccaaggtcaccaccctgatttttcctgataaagagaacaaggcatatgttcgactggctcctgattatgaagctttggatgttgcaacaaaattgggatcgtctaaactgagtccagctggctgactctaaatacatgtgtatcttttcaccataaaagaataatgtttttcataagagtgacaacttaattagaatcaaatctataagctttaagattttacatttctctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccgtcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctcaaaaaaaaaaaaaaaagggggtgaacttgaaggcaggtcctgtgtccatcttttcagattctgtatcccagcacttaggacacagacaaacacgaagatgacaatcaatatttgccaaaatgaaaaaacaaaagaaacatgtaacatcatgtaaaagaagctggttaggtggagaaatttatttaccatagtcttgcttgtggatccagtagtgacttttacagtttatatctaaatagaagctggaggctttgttggggactcataggcataaaatattatttattatagagttaaatgctacaaagacaaatctaattaataggcctattttcctttttaaattctactcataatttcttcatagtttttatgataaaagctggcaatgtcacatttctctgaccattctttcattgtcacatctctctctggactcagctaagaaaggttctccatttttaagaactcatgtgattagactgggcccatctgggtaacccaggaagatctctccatctcagtttgcatccttaatcacatctgataagcctttattgcattcggtgtaacatattcacaggttccagggttaggcatgggcatctttgagggccattattctccctaccacattatttgcctagcatctttcattacattgtccatctatttacttactgatttctaatgacatccaaatcagttacaacattttatgtaagcattgtttttatttttatgttattccactagtctatttttctactcatcagttatggtacatgagtttatttttgcaactttaagctcaataacatgttttaagatttcctcaactttctttttgcgcttcttcagaagttgactcttttggccctttggtcttctatacacattttagaaatgctttgttgaggactaagaggaatgctaagattttgataggaatttcattgaattttgagtatattggcatgctacaatggttagtgctttatacatgaaaataatatatcccttcctcttttcctagtatcatgagatgtttgttaggcagacatgaatattgagttgtatcaaatgtggttttctgcattattgtggtggtgatgtgatttagctcctttaattagttaatgtaatgaattacatttgtagattgctctaactattgaaacaagcttgaatttctggaataagcccaatgtgatatttattcaacaaatattcattgagtatacctagtatgtaacatgctttaagaatacaccagtgaaccaaacagaaatatctgacattacagaacttaacattccagtatttggagacagac

SEQ ID NO: 465483 - DNA, 5428 bp, Homo sapiens
ggaggcacctctgacctccagccccgggagtcaaaacgccatctgttgatggggccccgccaaagctgacatagacaggtccagcctccaggtgcccccacaccgttttcttgcattatgaagctgagcggcttctttctactctctgtgaacatcctcctttgcctctgaatgacccagcctggagtcttgaggagtgcagctgcacggaaaccgggatattgcccagagtttgatcttgactgccctttcactctcttacctatgcgctggcgtgataagagttgcagggggtcaagaagtgttgctactacaactgtcggcatcagtgtatggagccctggtggactttggattgagagaggagctaccctctctgcaagagcttcgaagagagaagctaccctttctgcgagagcttcaaagaccagcagacatccgaacaccctgcctgcagagaggagccaccctctccagggccccctctctgttgagagctgaatactcaagggatgatctgcctacagagagtaacaacccactacaggtctcctctgagctcttctaacactaaataaagctcttcttcatcgtcttcacccttcacttgtctgcccaggatgtggtcacacagctgcttggctgacccgggtgtatgtcggctgggggcaacctgaaagactgcttctctgtcctggaatgcaagcacaaggctgtccagctggacttgggggtctgtctgctggaggtggccccagagggctgcttcttagcccacctgaaggcttcccctggtgaggaagcctgtggtgttgtttctcagtcccagggcatggctgcacagctgctcatgcagcctagggcatgtctgccaggggcagcccacagcttttcttgtaagagagggttccccatccgccccccacccccactcagcccacatagcaggaggagcaggaaccttattgtgaactgtgcatgcaagggatctaggttgcatgctccctatggcccccactgccccgccccaccaccccctccctccccacccctatccatggaaaaattgtcttccacgaaatcagtccctggtgccaaaaggtttaggatcactgttgtaagatatgcctgttagtgatgaagttcttcagcttttgattgtctaggaaagtatttctccttcatttctgaaagacaacttttctgggtacagtatccacggataacagttttttttttcttcatcactttgaatatctcatgccactctccttctggcctttaaggttcctgttgagaagtttgtatgtaggagaaaacatccaatattttaccattagagatgatgtttatcagcggcataccaaggattgtggcagtgggagtggttcatctgaggaggagggagtgtttatctctgactctgtttaaaattgccagcacatagtgataatatacagtacagctttttaagccacttttattattattcttaaattctctacaattgggggacctatttattgcttacaactggggtgaactccttccaataacctccttccacttcagtacaccactaagatatgctttaagttgaatatagtgccctttatcatattgagagggagagcttctcttccttgcaggtggagaagttttataataaatgggttttggatttgtcaaatactttctctgttgagatgatcatatagtgaattacactgactaattttaatacaaaacatatcctgaatgtgtgtctcatttgaccttaatgtataatctatttaacatatttttggactgagtttatgactacttggttagagatttttatgcctatgtctatgaaggatgttagactgtaagtaaacttttttataatgttcttcccaggttttagtatcacagttatcttaggctcataaaagaagttgggaagtgttttctctgcttctcttgtcttaaaacatttttgtagaatgtataatttgtagatgtttaatagcatttacctgtgaagccacctggaccagcagtgtactttttggaaaggtttttcattaaaaatttgattgctttaacataggagtcaacaaacttcagcaaagagccaggaaatgaatattgtaagttttatatgccttaagatctttattgcaactccttgtctgtaccactataggacaaaggcagtcaaagatcattcttaccaatggatgtggttgtatgccaacaaacttcacttacagaatcagaagtggtaatctagtctcccagtccaggaatcaaagcaagtgtgtttaacttatatttgtttagttattcagttaattatttgtgctactttcttattgagatacaatttacaaaccatgacatgcaccttttaaggtgtacaatatagtggttttcagtattttgataagcttgtgcaaccctcaccacttgttaattccggaacaacttcattactcccatgaagaacccctatacctgatggcactcaatccttcctcctacctttacttctcccttggcaaccactaacctgctttttatgaattgacttattctggacactttatattaattaaagtatataatatgtggctcattgcatctgacttctttcatgcagaattatgttttcaaagctcatccatgttgtagggtgggatcttttttttttttttactttttatgtatgaataatatttcactgaatggatacatcacattttgtttatccatttatccattggtgaacatttggatgtttctagtttgtatgtactattattaatcctactatgaacatttatgtgcaaattttgtgttaaaatgttttcaattaccttgagtataattcttaaagtggaactgatgagtcacatgataactctatgtttaactcttcaaggaactgccagactgttttccacagaggatgtaccattttatgttcccaccagcaatgtatgaatgttccagattctccacatcctcactaacacttgttattttaggttttttttttttaagattatagctatcatagtacatgtgaagtggcttctcgttgtggttctgatttgcattttcctgaggtctaatgatatcacccatcattttacatgcttattggccatttgtacattttcttttggagaaatgtctgttaaaatctgatgcccagtttttaatcatggtttttgtcttttatggttgattttaggagttctttttgtattttgaatactaggcccttatcagatataaaatttgcaaatattttctcccatgtctgtgggttatcttttcatttcttattagtgccctttgactcaccaaagtttttaactttaatctatttttggatctattattccttttgttgcttgtgcttttggtagcatatctaagaaattgatgctgattaccagatcatgaagatatacatttatgttttcctcaaagagttttgtaattttagttcatatatttaggtcttgttttatttggagcccatttttgtacttgatatgatgtaacagtccatgtatatttttttgcaggtgcatatccagtttttccccattatttgttgaaaagactactctatccccactggatagtttttgtacctttgttgaaaataagacaatttaaaatgtaatggcttatttatggattctcaattctattcctttgatatattgtgtttatccttatgctagtaacacaacatcttgaaattgtagatttgtagtacacgttgaaataaaaaaatgtgagtcctccaattctgccctttttttttaagactgttttggctattctgggtcccttgcatttgtatacaaattttgggattcactgatctatttcaacaaaaattcacctgaagttttctagggattgcattgaatttatagatcaatttgtgaagaattaccagcttggcaacatcgagttttccaatccatgaacacagtatagctttctattttgggggtcttcttttatttccttgaaaaataattttccattttcagtataaaagtttctccattttttggttaaatgaatccctaattatcctattctttttatgctattgtaaatgaaattttattcttaaaaccatagagtgttgtattttgacattatgtcctgaaccttgctgaggtcatttattagctctaataatattttgagggattcttaaggattttctgtgtatgtatgtgtgtatatatatatatatacatgtacatatatgcgtgtatatatatacatatatatgcgtgtatatatatatatacatatatatgcgtgtatatatatatacatatatatgcgtgtatatatatatacatatatatgcgtgtatatatatatatcatcatgtcagtatttcttgcagtcaggttgatggtgatgaactcttcagtttttgtatatccaggaatgccttaatttttccctgacttctgaagaatagacataccaagatatagaatccttggttgataggtttttcttctgccgtttttaatgtgttctctcactaccttctggctttcatgattttaatgaaaaattactgtttagtttattaactgctcatgataagtggcttgtcccttgctttcaaaattttctccttgcctttgtcactaatatttcgatctaggtgtggatctcttagagattttcctacttagtgttctttgagcttcttagatgtagagattaatgtttttaatcaaaataaaaattttcgtcgtcattctatcttcatatattctttctgcgcctttctctttcttctctctcctgagattcccattatgcatatgtttttacactagattgtgttcttcaggtctctgaggctctgttcatttttcttaattattttctttattgttccttagagtgtataatctcaaatgacctgtaattaagttagccgatcctttcttctgtttctgtcttctggtgaacccctgttttgaatttctatttcattggttgtactttacaacttcattacttatctttaattctttctatgttgtaagacattattctcatacattcctttagtcttttgtccagagtttcctttagttatttcagtgtatttataatagctgatgtctttgtctactaatccatcatctgagctcctaaaggatcatctctgttcattgtttcccttcccttctctgtatgggcaatattttttgtttctttgcatgtctcgtaattctttaatgaaattggactttttacataatataatgtggccagtttggaaatcagattctctccccagggtttgtttgcacagtctttgctgttgattacttccttagtaactttcctggactaatttgctaaagtctgtatc

SEQ ID NO: 465484 - DNA, 2027 bp, Homo sapiens
gcagcttgtcacagtcatgggggagttcggggagcattggattcctggatccccagcaggttgataagactgtgagcccagggtctttttttggacgcctagtagcctcagctggccactgacccagatgcctcgagtccttggttttcttctccagggagcgccccacccaccctgcagtcctctcaagcctgcttcctccgaggggaaccctgagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacggtgtccccagtgataagtggctgagcgataacaagggttatccccttggcagctcctcaaatgttccaggcaccagctcgcctcagggcctttgcacgggctggtcctcctgtgggaaagcttctcctgcatgtccacacggcctgcattcttggtgtcttcagctttatcgacagcatgcagccaacacatcaggggacctctgagtcccccacaacacaggtcttcacatccctcactgacttctcgtggctttcctgtctcactttgccacatggagggtcaagcaccacagttggtctctggcttcctgtgtgtcttgttcttgggcccagtggggagcccacagagtagctacttccacagcggtctgccccctaacttctctggcctctgtttatttatttatttatttattttgatatatttgacaaatctctaaactggaatcccatttcttcaagctcattttcttctgttgtttctttctcctccttactgagcctcttcactcagagcacacagggatctgtcccccaggctcccactggacagggatctgtcccgcaggctcccactggacagggatctgtcccgcaggctcccactggacagggatctgtcccgcaggctcccattggacagggatctgtcccgcaggctcccattggacagggatccttccagtttcttcccttggctaaagggcaagtggtgaagcctgcggccctgctcaccccagctcgggtttgggccttgaccttcaggaaagcgtcttcacctgtttgctgaccctggacttctgcctgctttcctggctggggtggggttcctggcactccaagtcccccactctgagctccttggggatgtggctgagataagccccagctgcctttttctctgcatccctggagggacgctgtgaacccaccgtttccttccttgtctcacattcaccacccagcgcttcccacctcaggcctacatgggcccaccaagtgccctggggcggggatgtccagcagcctgcgtcccactctcagccccaccctctaccactgtatggccgtacatgattcacttctccctgagcctccggtttttcatttctaagaccaaaaagggactgtgtgccttcctcagtgagctcatgtatttgggcacgaatggtgcatgcggacatttctgccttgatattccatgttccccaacctggtccctcttccttcttcccagagcccttgagcctgaagagactcggcctcccatgccagccacacagccagcctggcctggcctgtgtacagacccctgagactccttgtgtgtaatacacacattttgaggccatgttcatgaactgtcatgacagatgctgctccccggccccagcctcagcccctgcacagaagtcctgagcattgtccccactttagaggaggggtatggctggtgaggaggggcgtggccatttttttccttctgccctccagcctttgcatccctttcctccacagtaatttattcatctgcagaatgaatatttattgagcactgactatgtgccaggcattggaccaggacactggg

SEQ ID NO: 465485 - DNA, 2513 bp, Homo sapiens
ggagggatggggaatgggagggagacctctgcagcccccatgtctgcagcaacagctgggctggtcttgggagctgaagtcttgggagctctctgcgagctcctggctgtggggatgggtgtggctggacctaccttaccattgggtcaagccagtgcccactagtgcccactactgtgcctggcccagagacagacagacagacagacagacagacagacagacagacaaaccggggaagccgccagcccagggccttggtgtggaactgaggaacaggatggtgcccgcagcaggggtggaccccccttagtctgcaggcacggaacaggcagccatgggtccctgtctctccttctggactcagcaatacgagcatacggctttgtctgcttttgctcactgtggcctcctggggctagagggagtggaagcttaccatgagtacctgtatgtgggccccttcctgcagacaccaccagagatcaggtcagagcaaggggccgccagtgttcaaggacagccgtgggaggcagccaggaatcaggcaaagatcccctgggccctccttggaaaagggggcatggctgtgccccttggggctccttgctgggcctctgccctgcctgcctgggctcctcccggcctcccccacagatcactgttgacaaggttactgagtcagcatgtaaaacctgcaaaaataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacggtgtccccagtgataagtggctgagcgataacaagggttatccccttggcagctcctcaaatgttccaggcaccagctcgcctcagggcctttgcacgggctggtcctcctgtgggaaagcttctcctgcatgtccacacggcctgcattcttggtgtcttcagctttatcgacagcatgcagccaacacatcaggggacctctgagtcccccacaacacaggtcttcacatccctcactgacttctcgtggctttcctgtctcactttgccacatggagggtcaagcaccacagttggtctctggcttcctgtgtgtcttgttcttgggcccagtggggagcccacagagtagctacttccacagcggtctgccccctaacttctctggcctctgtttatttatttatttatttattttgatatatttgacaaatctctaaactggaatcccatttcttcaagctcattttcttctgttgtttctttctcctccttactgagcctcttcactcagagcacacagggatctgtcccccaggctcccactggacagggatctgtcccgcaggctcccactggacagggatctgtcccgcaggctcccactggacagggatctgtcccgcaggctcccattggacagggatctgtcccgcaggctcccattggacagggatccttccagtttcttcccttggctaaagggcaagtggtgaagcctgcggccctgctcaccccagctcgggtttgggccttgaccttcaggaaagcgtcttcacctgtttgctgaccctggacttctgcctgctttcctggctggggtggggttcctggcactccaagtcccccactctgagctccttggggatgtggctgagataagccccagctgcctttttctctgcatccctggagggacgctgtgaacccaccgtttccttccttgtctcacattcaccacccagcgcttcccacctcaggcctacatgggcccaccaagtgccctggggcggggatgtccagcagcctgcgtcccactctcagccccaccctctaccactgtatggccgtacatgattcacttctccctgagcctccggtttttcatttctaagaccaaaaagggactgtgtgccttcctcagtgagctcatgtatttgggcacgaatggtgcatgcggacatttctgccttgatattccatgttccccaacctggtccctcttccttcttcccagagcccttgagcctgaagagactcggcctcccatgccagccacacagccagcctggcctggcctgtgtacagacccctgagactccttgtgtgtaatacacacattttgaggccatgttcatgaactgtcatgacagatgctgctccccggccccagcctcagcccctgcacagaagtcctgagcattgtccccactttagaggaggggtatggctggtgaggaggggcgtggccatttttttccttctgccctccagcctttgcatccctttcctccacagtaatttattcatctgcagaatgaatatttattgagcactgactatgtgccaggcattggaccaggacactggg

SEQ ID NO: 465486 - DNA, 3183 bp, Homo sapiens
cgcgtccatgtgaagagaccaccaaacaggctttgtaactaaggcgggccgggctcagaccagcgctgcctcaggatgtgaagtgtaacaagagggccaggggaggtggtgggggacaacatgggcctgtgaggcctgtgggtgcccgcgttccccagctccccccgcagcccgctccacagtggtccgctccggttggttgtcacgtgcgcattcgggttccagacccaaggctgcgtgttctccaccgcttgttgtggccagtgttactgcggtgaccgccagagcagcctcgacgctatggaggagcccggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgacaattctcaacttcagacaagccataaacagctttttcagcaagaagctgaagtatggaaaggacaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagctcagccgtgccactgaacagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcacttgatgtttcaaatacagcatttggcagagagcatgccccgaatggtcccgcaccattgggtcagcgttcatctgaaacgagagcttttctctctcctcaaactttgttggaggatccactgggactctcacctgtgcttccggagggaggaggaagaggcccaagaggcccagggaatcccctggaccatcagattaccaatgaaagaggagaaccaagctgtgacaggttaaccgatcctcacagggctccttctgacactgggtccctgtcatctccggtggaacaggactgtaagatgatgtttcctccaccaggacaatcatatcctgattcagctcttcctcctcaaagggaagacagattttattctaattctgaaagactgtctggatcagcagaacccagaagttttaaaatgacttctttggataaaatggatgggtcaatgccttcagaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctacccaccgaggggtttacctccttactttcacccgagacctggattttaccccaaccccgcattctgaaggtagaagcgagttcccttcaggattgattccgcctttaatgctactgaacatccaggaccacaaaagaaacctgacaatattgttgctttcttcaaaagtaattttgactgatctcattttcagtttaagtaactgctattacttaagtgattgcacttttgctcaaattgaagtttaatggaattataattctcaggatagtattttgtaaataaagatgttttaaataggaatcttatgagtaaatcattccattttattattctagatcatataactattttaatttggtgaattaatccactgttatagaaacaataatgggagttttatatatgtaatcttgcaggtggggaggctttaaattctaaaggttgtggtgtcttcatgccaagaactgtattcactgtggttgtagataaatgtgaaagtaactttatgcttaatttaataaactttagttgattttttttttaaaaagaaaactgccagaactgaaagtaggtatagatgaatccacaattatagttggaaattttctcttgc

SEQ ID NO: 465487 - DNA, 869 bp, Homo sapiens
tttatgaatatgtctacaaaaaagaaaactaaaaaatgtttgaaaatgtatgaaattattgtagttgctgatgacaaagtggaatattgccttatttgttatttctccaggatgatagcttgtattccaggaactggatggtacccactatttcctgaatgtccatgtgatatcagaataatctggatctacaactgcataatttctgtccagttgcatgcattgaatagataccttttacattatgcatccataccaggtgaaggaggcgagggtgtaataagtaactctgctggaggctgtgtagctgctgtttccccgccgagcccacagtggaacaccaagaagcatcctgaccccgcctggatcgaggcgagggcagctgaggcaagaggctatgacaagtcacgctggaaggaaactgtaatttaaacctctcattttacaagtgaggatgcagatgctaaagagattaagtagtttacccaaagtcaacactagattgatggtaagaggaattgccaaccaagaagagctgactggtatctctagatgaagcatctgactctagcctctctccaaaaggacaaatgaactctcagcttctcgctgggtttatccagtgcgtcatgtgcaagtagaaagaatgaggtgatatgcagctgctgaaggagtagtcaacagactgaaccaattttatgtgactgagaatcatgttggctgtaaaaagggattaagctccagttatggcaccctgtaaactcagatggcaacagataacagaagacaggaaagttgtaaaaataattactggaaataaatgataaagttatatttgaaagtttgaacagtaagcttccatatgacac

SEQ ID NO: 465488 - DNA, 1261 bp, Homo sapiens
ttatacccctattatagataaggaaactgaggctcagagacaaagtaactttgtcactgtcacaaagctattctacacatgactctcttccttgtttttatactttttggtggggtgtgggtagtgaccattagacattccaaagcactgtcacttggtgtagctcagtgctcttggttactgaagcaacaagtgatctctgatgacaaaacaaagtataagcagcagagcagcccatgctgctgctctgcttatggagtagccattctttatttctttactttcttaataacttacttgctttcactttactctatggacttgccccaaattctttcttgtgggagatccaagaacactctcttggggtctggatcaggacccctttcttataacaccaccacctgctttcttgggtctccagcttgcagatggcagattgtgggacttacttcttagccttcataactgcatgactaatttatcatattaaatcttattttctttatatatatctccatcctactggtttctctggagaaccctaatacatttcccatctctctgcagctagaatcagccagaaacatataaggagactccaccaggagtggggagttcttgggaaagcttttgcttctgaaaaaagataaaagtacacaggagagctgtctggtgccattccttgagcatgtgagagactgtgtcaccgggagcagcagttatctgtggccataagttgagatgactggatgaaatgctaacatgttgagaagacaatgcataggagtgaatgagacagaaagcaagaccatgaggatgactaagaagagcaagtacaacatggctgagactaagtgtccagggagttgagaataagtggcctattgtcatgtcctatataagtagagtatatggatgggaggccaagaatacaccaacaaataaaatattgaatatatcggtcaagggcatatcgagatgatcaggatgctgcctattggaatgtttatcctcccaccctaccccagaagaggagcttctcgtcttgttcaccgctgtttcccagctcctggaagagcctggcacataaaaggtgcacaatgaacattcattaaaatcaatgattaattgaactggctagtattccatctcactttcattactggagaactgaagagccagctagcctacaaaaactcattctggatgtagaagcaataagaaaacatgcattcaaataaaagcagagaatccttct

SEQ ID NO: 465489 - DNA, 708 bp, Homo sapiens
tgctgctctgcttatggagtagccattctttatttctttactttcttaataacttacttgctttcactttactctatggacttgccccaaattctttcttgtgggagatccaagaacactctcttggggtctggatcaggacccctttcttataacaccaccacctgctttcttgggtctccagcttgcagatggcagattgtgggacttacttcttagccttcataactgcatgactaatttatcatattaaatcttattttctttatatatatctccatcctactggtttctctggagaaccctaatacatttcccatctctctgcagctagaatcagccagaaacatataaggagactccaccaggagtggggagttcttgggaaagcttttgcttctgaaaaaagataaaagtacacaggagagctgtctggtgccattccttgagcatgtgagagactgtgtcaccgggagcagcagttatctgtggccataagttgagatgactggatgaaatgctaacatgttgagaaggtaggacaaaaagaaagaaccagggacactgatgacattgttgaggtgcatcaaccctagaaccattattaagagatttattatgtgaaatattattatttactgttttactacttgtagctgaaagcatttctaactgtgtacaggactacttttaaacgcaagaaagaat

SEQ ID NO: 465490 - DNA, 960 bp, Homo sapiens
cagtaaaatggttcaatgtaaggaacggatatggtttcatcaacaggaatgacaccaaggaagatgtatttgtacaccagactgccataaagaagaataaccccaggaagtaccttcgcagtgtaggagatgaagagactgtggagtttgatgttgttgaaggagaagagggtgcggaggcagcaaatgttacagatcctggtggtgttcgagttcaaggcgcaaaattaccagaacagtgagagtggggaaaagaccgagggatcggagaatgctcccgaaggccaggcccaacaatgccggccctaccgcaggcaaaggttcccaccttactacatgcggagaccctatgggtgtcgaccacagtattccagccctcctgtgcagggagaagtgatggagggtgctgacaaccagggtgcaggagaacaaggtagaccagtgaggcagaatatgtatcggggatatagaccacgattccgcaggggccctccttgccaaagacagcctagagagtacggcaatgaagaagataaaatcaaggagatgagacccagggtcagcagccacctcaacgcgtgtcacgtgaccgcgccgggtagagggagacagagtcgcacggctgagacgccaggcagtcgcctagcaacagcgggacgcggagcgatggagaccagcagcagggagctccaagccgcggagtatttggaaaagcatcagatcaaggaggtggttagctacctcaccagcgccctccttttctttcggccggttttctattctatcatctgagatagggcatttgtatatgtaattatttaagtgttcaatgtcttaccttcttgctggactgtttatgaaaactaaggcctgtgtccccagcgcctagtacagtgcctttgctatagctgtttaataattgttaaatgactacttctatttgcgacatattttaatttc

SEQ ID NO: 465491 - DNA, 2345 bp, Homo sapiens
ggagccgagagcatcaggtgggcttaaggtttcttctgactcaaagcctgtaatttacaactgcccacaccaggcacaacagaaacttctggtcaacccaggagaagccagtgcaatgctggcgtgtatggtactccccagcatgtgtgggaaacgtagcgaggatgaattaaaccctttcctctgtggccgactccaccaggctcctccgcaggagacagtgccttgtgctgcagcacaacccattccagggggaggggcccaaagctccatgcccacagggcccaacgtcagcccaagcagaagtttgctgggagagcccctcctgctcctgcaatagccatgtggctgcctcaagggttccgttcgagcgctgtgtttgcagaagggttccgttcgagcgctgtgtttgcagaagggttccgttcgagccctgtgtttgcagaagggttccgttcgagccctgtgtttgcagaagggttccattcgagcgctgtgtttgcagaagggttccgttggagcgctgtgtttgcagaagggttccgttggagccctgtgtttgcagaagggttccgttcgagccctgtgtttgcagaagggttccgttcgagccctgtgtttgcagaagggttccgttcgagcgctgtgtttgcagaagggtcctgttcaagtgctgggagcacagtgctttcttccagggccaccctgtgccaggggccctgggctcgtcacctccctgggatgctccttcagcagcaagagcactggctgggcccctctgaacgctcctgtgaggacgttccttggggaatcacttggaagtgctttcagctcagcctccatagccctgcggacctcagtgaagcgcaggcataagtggattttgaatctgtctgtgtcaataacatgctcactctcaatgagaagctggactcattttttgtgtgtggtgtcttaaaaagttcttttattttgtcagcccaatgccaaataattggatgactgaagttttcactttttagatttttttttaatgtgtcatgttttcttaacctttttattttgtaatcagctttctcaggttgaaatgtttttcttttctctgaagatccctgacaaacacaattgctgtcacgtgtcatgagcactttgggttccaaaaaagactcaagtaatgcccggaacagcaccctgttaactgaacaagggaaaagccgagcaacgtgctttgccatcactaaatgcacagaatgtctgaagaattaggccccctcatagcaccagtcatctgtgtgtggtgctatggtgctaccagctcactcctggggcctctgagaaactttgctcagtcactcatttgaaggtgtcacagtagcatgagggacctgtggccagtctagaccctcattcccaatgttctgtcaataattctgtccctaggtgctaagtggccaaggttattttgagaaatatcttgtgcatcaagagagaagttggtgcatgtgtgcgtgtgtatgtgtatgtgtgcgtgtatattatgtgcatgtgtgtatgtgtgcatatatatgtacatgtgcacatatgtgtattatgtacatgcatgtatgaatgtgtaaatgtgtatgtgcatgtatgtgtgcatgtatgtgtatatgtgcacacgtgttgtgtgtgcgtttattcacttgtgtgcatgtaggtgtattatgtgcatgcatgtatgcacctgtgtgtatatgtacatctgcatgtatgtgtattgtgtgtgtatgcacacgtgcatgtatgtgtattatatacgtgcatgtatgcatgtgtgtatgcatatatatgcatgtatattatgtgtgtgcatgtatgcatgtttgcatgtgtgtatgcccgtgtatgtgtgtgcatacacatgtgactcttcctgtttttttctgaagcctgttgtcccctaggggcagagttggactcttaatgggctcaaacttgctgaccactaaatttctgttagtttttatgaacaagatactgtcttacatattctggcccttttagcagattttccttccagacagtgtgggtgggaggtgacctcctaggacaggactcaactacctttctcatgtgtgaactctcacagcgtttcctttgtgtggatttgcacatgcagacatttatgtgtgcgtgtgcatgtcttactcaagactggctgctggaaatgtccagagttttaagttcattatgatgcatctgacaagttttcctccttgcagggtggaggggcatgtcatacagccccagggctttttacaagccaccccaagccccaccatttttctttctttctgatgttt

SEQ ID NO: 465492 - DNA, 849 bp, Homo sapiens
tctacggtatgtctttatcagcagcgtgaaaacggactaatacagggggcaaggtttgaaaaacttcctattgggtaccatgttcactatttgggtgacgggttcactagaagcccaaacctcagcatcatgcaatatgccagtgctcggtcacggaaggaccgatggtggtgtcattcacagaaagtcagccaggactgcagagagatcatcgccagtggatgctttctctgacctttccttcctgcatgctgttgggaagactggccccaaatccaacgggaaggatatcagagaccaccggcatcgcaagtcaaggaatgggcatggacgcagcagcagagacaaggcgaccccacagaccacagagggcacaagccacaccgtctccttgaaagagttggtggtggttgtgaggaaaaacagagaatgtagctttcaggattcacagcagaaatactgtaaatgtgagtgtgttccatttgcatgtgtttaagcaatgttgaaggaagacgtcacagacagatgaagctcagctaaatctctttatgccactcaagttgttttaaaccagtaacgaacacctgagacctcgttgcttgtctggcagtcggacaaggataatctaggtactcgaggtttggaaggcggaagtgaagcagaaggcagaagtgaagcagaaggcatcagattgttcctctggcaagtgggcttttgcagatgtgccattttacagtggcttccacttgttttccttgacaacttccttgaatgactgacccagccccaatgtgcctatctcctgtgaaaaataaaccatcagattgggactggtttgagtttccatta

SEQ ID NO: 465493 - DNA, 4597 bp, Homo sapiens
gtgaaaagatcacctaacaccagctggctgaagtttttaaaaagtgtgcagcccgccgcccgaatgcaaagtgtggcggtcgggcatgagtgaaacgtgatggcgctgccccaaggcatccctgaagcctttttcagccctgggttggggtcagggtcagcacagagtgacttcatctcacaggagacacagtgtcagggcgtcaaccagggcccaacttctccagtggggtttgctcggggtgaggaaaggcaaggatattctgatactggctcaagcctggcagccgctgtgatcacctcctacagctggagactggaaggagagagtgcccgctgctgggggaccctgcaagcttccagagcccccttcctccaccttcaaagccagcactgcacctctcagtgctgttcccacagttccatccccctggccccctctgaccctgcctctcttctgccttctgcctatgagaaccatggagatcacggtggacccacctgggtaaccgagtataacctcaatttccaggatgggatcctgtccacccaggtctggagcccacacaccacatctccagagcctgagttggccacaggtacaatggagaagcttcgggtgaagctgatgttgaaaaagctgagaaccgggagccggaggaaatcatagcgaaatctcaacctgatgtagccccatcagcatcacacacacactcagagcaaaatggcctgctcttcaatgtagcttagtttagttcaattgtcctgcccaccccctcctgaccctcctgccgctgaggggtggtatttgaaagaacagcttctttcctctcttctccttgggacagcaacagcacagagagtgggccgccatctcttactgcccactcaaccgttgctggggactgattctttcagctctacatagaattcaagaactatatttggatctgcttcagagcagtaatccccacagccttaaaacatgcaaaataaaaataaattaatcatccatcagcattttatggtacatttataattttatttaaatgtttaatatcataaaacaagcttggctcatggagaaaactgttgatttcatgagaagaaattgctctcttttaaacgaaagtaaatactctttagggcatccccagataggaaatgaagatgaaggaagctgttcccaagttggccaaatctggcaattattctctcaaagacagcaatgtgtcacagcaaaatgcgacaattccctcaagtgaccagtgggactgatttatgagcaaaagcaaagacattgttcccccaaacgacttttgagttactaactccctgagagggaagatcatggaaggagggggacccaggaggctcaggggtccagaccagctctgagaaggacctgtctttcacctttcctcaaggttctgttattttgaatggcagatcaccatcactttcaaggcctggccttgttctctgattggtcattcttagagagagataggttgcccattaagacccattgttctgactctgaaatgaaagaaaatgaagcaattaacatcttggcagtgggcagaattaatcatgcttgaccatttttatttaagttctcccccaaaatgcagcaccgaagggcacttattagttcacacaaagaggcatctctgaacagcaaacactcaattatttcgatgtttactgttgagaaaactgcaaaagaaaatatgcattcaacagacacattctgaaaggtctttaaaaatgaggctattttcacagtttctaaggcatatcctataattttgttttttaatcattgcaacctactggattcaatattagattcttatttctacctctccaaaccctcatcatagtcttctggccattcagcaaaatacattactttgcaaagctgaatgtaagcatagacatcttacattcagctttgcaatgtcttacctccactgtcacaaaattaggtagcacctcagatcaggtgaaggaaaaatgacacatcggatttgtagactgtcttcctctctcccatgaccacagtggtcaagtggttgcattgattacctgattaatggcctccttgtattcctgtcccactggactcttggctcgctcagccagggggctttctttggccaatggatgttagcaaatgtgacccaagccaagttctgaaaagatattcactctctttgacctctgccaccaccgagagaacatactcagggttgcttgacagaaaaataatctaaaagatatctagaggagaacggactggcctccagagccaccctggaccagcagcccccaaccagcatgcagctgattgcagcacagcgagccaccccagtagaggcagctgagcctggctcagatcagcagaactgcccagccaatccaaaactcaaagaaaaatagtgaatggtagttctttcaagccattcagtgttggggtaatttgttatgtggcactatagaggcaataggtagctgatacaaacctaaccccagctgccattcattaagcacatgttatgtgtcagggatggcgccttgtaaagttgacactttacagactcaactctgatctgcccagtgatgccaccagtcaggtgtcattattctcatttatatagataaggacacatgccttacacagtagagtttagtaagcatgtgagaagctatgtttggacccacagcagtcccctcttccctcaagttacctgcctccaccatgacagtttgccctgaatccctggctctggtgccccaccctgagcataaacaggtcatcatgtgaataccaacaaactcatgttgaccaggaaggactaagccatgcctctgaactgctgacacgtcatgtgacctgttctggaaatgctatatgggcatgagcaaagcccaccttgaatgtctaaaaataaacatgagccaggagttcctatctgcagccactcatcagcattttatcctcccagctcacccactcatcacactgtaaaatgggattgctccgaacaaacccatacaaggcagatgtccagcccaccactcatgcccaatgatgggggaagcgacggtcactctcccacagcaggcctctccctgagatcaccctgttctggcataaatagagtgtacctgtgatggaccaaattcatccagctctcgttctggatgtcctcctagcagaagctggctactcttagctgaattctgctttgttccctaataggcactggcctggatgccatgaaagggccaggagcttgccagtcctcctcactgtatctgcagctttaagcatgataagaaatacaacaagtgtttgtagacaatgaatggtctaaatgtacatatggggagttctacgagcaatgcatcacaattccagcacacacttatttgcatctattaatgtttcttgactttggttgcacactagaatcatctgagctgttctgaaaagcacaaacacacagcccccatcctggagcaacaaaacatcctgggctatttgaaggattcctgagtagagctattgcttgaattctctctgggtcaatctgatgtgcagcgagggttgacggctacccttctctcctatttcaatttaaacacagaattttagccaactcctttctaaccctcatgatgtgatgtcatctctccagggagatcttgcatagtgttcccaggagaaggcccagcaaaacttgcggcaagaggaagtaaaaatcctgcccccaccccttctatacatgcctgcaggtggcttcacaaacttgttttccctgcagctgcttgcacatgtaacagcttccaggataaccaatgagctggaaccagtaagatgtggctggggaagggggcttctcatctgtcagctggggagcctcatggggccttacatggactcagcttcttaccagttccagaagagcacccaaacggccctgggattttcaactctgaagcataaggtgggaacccggcagcaggctggaccctctggcccccctccctgttgtcctccatgagctcccagtcccgttcatatcagagcaaaaccacagctggtgggacttagcggattttgacagcatgttgattatgaatattgtccctttcaggcaagttaatgaagcacccaattcacaccagcttttatctgtcagagaaacaccagcaagcaaggtagagacaacaagccaaaccctgatgtgcaagtatgaacttcatgttaattaggaatcggaagaatgtgtgggtttctctaatgcactcatcatacgaagccagctgattcaaatgctctcaacctgagcttcgggtcatttgtgttagctgtaaggccatctgaggcagatgcattgaacctgaccttgagagtatccttgaccactggaccaagaggccagagactctacaagtgtgctcaggccagatggctaactcaactagtgcctggcaggaagactcaagatgccagcttctcccctaaaccatgtgaacattcaaccattttaaactataaaaacagcaatttcaaccaaaacactgga

SEQ ID NO: 465494 - DNA, 1366 bp, Homo sapiens
aaattcacagagaaacatgaatggatggcaacagaaaatgatattggaacactgggagtcagcagttttgcacaggaaacgttgggagatattgtttactgtagtctgcctgaagttgggacaaaagaacaaacaagatgagtttggtgctttggaaagtgtgaaagctgctagtgaactctattctcctttatcaggagaagtgcagtcctacccaggaggcctgcaggctctcctgcagctcaggcctcactctctgacgcggcactggagtgatgttgtggcaattggtgtccatgtaatatgtgagctgtatgctgtgggctgtgcctcagtagcagatggtaggggtcaaaagatgacaccagccaccagtagaaggcaagtagaagacattataacatactgctgggcccagaaccaaggtgatgttaagtcttctgactaaaacctacccacagaagacattgtgacatatctctgggcccatcaactatttgatgtgactctactcttatctgagtttttttaataaaagagattttgacatatctttgggcccagcacctaggtgatttgactctcttctgctgtgtgagccatgaccagagatggagagtgacttatcgcctgaaccagcacacaaattgagcagtgactctcataacaagagccaggaaaggtgtgagattggtagtctcatccctggacctcctgcaggtgtgattttgacatacacctctcctcagcacctgagtgatttgactctcctgcctgagtccagcttacaaatgagattgtgacatatcactggacccagcaccttggtgctcaggttctgaatgtgctcaggttctgaatatcacatctgaaggtggtggaaagttggaaaattgactcccctacataaattccattcacagaatgatgggtgactcaggaccaagatttagcacatttgtgaggctgtgactctgctacaggagcatcttgacagatcgctgggccttgcacccaagtgatgtgagtctcctctgctgcctttgtgctttccacagggaacattgtgacacatcgctgggcagcacacccgggttatgtgactctcctgcctgtgccctgcccaaagtctcactcactgtaacacacaggctagactgcagtggtgcaatctcagctcctgcaacctccactttctgggttcaagcaattctcgtgcctcaacctcctgcgtagctggaattacaggaaatgtgtctctcctcttctgcctgcaccttgccaacagagaaaattgtgacatattactgagcctagcaaccaggtgatgtgtctctcctgcctgggcctggctgacagaaagcag

SEQ ID NO: 465495 - DNA, 3084 bp, Homo sapiens
cagggccaagcctgctgctggggaaagacaaagagggccctctggtgtctgggtcatcctggacacaggcaaaatgtatcttcttcaaaattgcctagtgggctctctctcactcatacttcagcacgaatgggctggcgtcaggccgttgctggcagtggctgctgcaggcttgtttttgggagcagagtcaaggagcagaagagctatgcttagaccttttgtgatgcttggagaaaccacccacacccatccagaccccagatccaggaaaacacctgggaagaagacaaaaataactatgaaagcccacgtggatgcaactggaggccgttatcctaagcaaattaatgcaggaacagagaatgaaatactgtatgttcccactaatagctgtgcttttcctgcagggactgaacaagggcagtgtgtgcacatgtgggagtgccagaagcaccagcgcaatccagatgtgcccaggcccatctgtgcgtgaaaatgcagacacaccacactatttatcaattagtgtctgctgctgccagtgtcaccagttctctgcctgatgaatgatgctaggctggacaagccacaccccaagatatcccgctgcactcagatacaagactgaagaagcaagaacgttataaaaaagaaagaatgaaaagaaagaagaaaagcaactaagcccagagatggatcccaaaactgaagaattggtttaattaaattgaaagctctggtgcttgtggtaattgctatgaaggaatccatatcccatcagaaccctctcccctggagtttgctccctctactttctctgcagcagcctgctagccagagtcaaagactgtgtgcatttgaaatctccaaccttttaaaacattactgtgaagttgaaagttcctggtgtcttttgattaaacatcgtgctagcaacaataatattgaccacgtttgagacagaagagccacaagagggaattagcctaaattcctaagcgcccacctggaaaggatcctccttggaagatctgtcagatccatagtaaactttgaatgaaagagaaataaaatgttatgtgttaaagttcctgaatttttgaagcttatcctattctatcctatctcatcttaatatactaagttattcatctggatgtctaaaaaccatgaccatcacaataaaaccttacactgctatcaaagtaatcaaataaatagatagggaaacaaggaactttagtcacttaggaaaaaaaaaaaaaaaagaaacatacctgacaatgtcccctccctccaccccagtggttactggtacctagctttatttgggaaagcaacaaaggaaatatttccagaggctgaggcacctctttggtatagaagtccatttctgcactgccttttaaaatggtcaaataatccatgttgaatttctgataatcagagttctatgtataaagaagccaaggtcaacaccactgccatgaaatgatggatgtaactatcaagcagaggtcaaagaggatcagaattcaacagagaccatgggatgtggtcaacaggaggtcacaggctacctttttaaaagagtagcttcattggaaaaaccagattacagagggttggggaaagagttagaggtgaaaaaatgaaagtagaaactctaaactacaggctcaaattacgtggtggtaaaaggaaagaaagaaaactgtagtttaaaagagaaaaataaaacttgagtttgaaggtagaggtgaaaaaacagatgataggaagaaatgcaagattttgaaaatttggacagaaagtcccatgtatgattgaaggaaggagggatcagagcacagggggaagacacttgttaccaggaggagaaacacatgagggtttaggtaggtttttcttctgcatttctcacttgagtcagtgcatcaacatacaactaacttctaatggccaagaactccaggaatcatcgcaaacatgttttatgtccttcagtcttccctgcattctgttatcatcagtgctatttaacctcctcaatatctcttaacctatacctttgtctgcatttctacagccttaaatcaggacattaattttgatggagctattcaaatcatagctttacaagtacattacaaacttctcagtttctcatctgtaaaatggaaacaaaaacaactaatttttttaagcactgctgtgaagattaaattaaataagcccctggcagtggatcacaaaaacttcttgcttggtatccctagccctggatttcctagtttttatttattcactattttgtcaccagaatgatctgtttgatctgtttgacaatcaagtcttgcatagtttcattcctgcctaaatcaagtcagttggtctctttcatttatagagtaaaatccaggggttcttttagtatgatactaggatacagtatgatacaattgttgcccaactcttcagtcttcaccaatctctcatcttaacttatgtcccagcaacattacacttcttatagcttcccttaagacacagtaatgtttcaaagtttcctatgactttgtaatgctgttccttctgctgaaatgtccattttctctctggttttctcagcaaaatcctattcatccttgaaacccagctcatatttggcctccttaagaacgttcttcatcgctcgttctccatgttacctctccataatgtattcacttcggttgtcacacttaactcattatattgtcatttatgtctttgcatgtcagctttcaataatcatgaatgctttgaagggcaggctgtgttttatttaactctgtaactctctttcctaaagccatatctactacctggtaggtattcatcaaatgtttgacaaatgaataattgaacaaatgcatttgcctgtatggagcaatcataaaacggtcatgaagatgatccctacatagccctcatcttcatggagcagatgtcatccactctgagtgatgtctgtgtttctggaattgttgaaagtggaagcattggaacctaatgttgggggaaaatataatacactaa

SEQ ID NO: 465496 - DNA, 2524 bp, Homo sapiens
gaggccccctttagggctgagggctcctctttgccaagcagctcttgtctcacagaccctcgcgccagccctcaattgtcccaattctgctgatgaggacttggagacgtggccaggtacatcacagagctgaggccatgccaagctcggcaccctcccagtcgaggtgcctcccccttgctcccctctcagccctcaaagtcactgggactcatcatctcaagccagaaagtggggccagatggtggcagatccacgggtgtctgttgcatcattaagtgagggtgaaaaatgttgcttgtaattaaacaagggaaccaggacagcagcggcccccgccacagctggggcggctcaggaagggaaggaagactggctgagagtgaggggtgggggaagaagcctgtggaggttgtgacctctgttcctcccctaacatcccagctccacctctgccagctgcatggccttggctccgtcccctcctctctttgtgccttagtttccagacaacagcaagagcggggcttgtcctggtcttgtctcacctgtccccacctcagggcctttgcacttgaggtgccccctccctggcaggtgcttcccacacccagatcttcccagggaggcccctccacctgctccaggtcacagctcaactgcctcctcctcctagcggcttctcgagctctcccatctggtcacctgcttctgttttctccacagcttggcttggtgccctgcacacagcttctcccacactgctcttagccccacagatggcagccgagaggtggagcggaaagtatgacccagtggacaggggtgacctggtgacgaatccctagacagcgcagatgaggctgtggggcagcaggcgagtaatctgtgggcccttcggcatcttccacccaggccctgtcagcctcctgtttttcccctctggctccaggagattaaagtcctccaagaaatgcagctgcttccgtgacaagagggaattatcatcttcggactcaggagacatcctgtggccacggctccctggtcagcagcaggccctgttgaatgggcaggcactgggagggaggccggaggtgtggctcctggagtctcacagctgctgctgtgtcctacagttacaacctgtcctgctgctgagccccatcccagggtggggcgagacggaggggcggtgccgaggggagaggcagcgcagagggaaggagcggggcgaggagaaggggcggggcgagtactgctccaagatatggcaaccgtgacagctttgcgagtagctccaggtcccctgctgctccgtgagaaatcaaacttctggcaatgacgaagcatgaagccagcatctcagggagaggggcggggcgcagttcttgcgggaggagcggggcggtgcgctcctggccacgcaggctggaaactgtagctctcaacggttccccgcccgttggtggcaaggcggctggactagaatcctagcaggcgatatgcgagaaggcgggcagcccaagagggttgggcagggcagtgtggatctcgccgcttccacagcgatgctggctactgatttcggacacctccttgccatgggatggaaattaatgttatgactggataagacaattgtgaagaaactgcacttcgaggttgtctgtctccgtattccgatggaaaaggctggactttagaagcattgctcgctccttcagtttctaacaagtcagtattctcatagcaatttaaatttaaatgtttgaattgtttctccttccctcattcacctgaaacttctgactccagggtttttcagttggggtttagagaggataactcccatatcgctgttgtatctatttctcttcagcatctggctgcatgtgctaaagatcatagaattagaccaggtcctgtatatattttgggaccaaaaattcaaagtaatcaactcaagacaggagtctacaactttgattcttaacaaaagatttcctttgatttccccaaatctttatgattcctagaagaaattcacccatgggtgaagcatgtggttctgttgaataacattttgttggggatttccacccactcctccctactttctggtactcagccccgtgtttttctctcctcacattctcaaccctatctctttaatgtggggacttccatgcgttgcctatatccaaccaccctgcactgccaggaggctctgcaggctctaagctggggcagcaatgtggtccccttagtttcagcctccagacctcagtcctgtgctccttgcagatgcttctagtgtctggaaacatctggttcatgtagttggtctggcttcctatgtgtttggttccagagggagtctgtttcttgctcttccaccatacagagaaggcaaagctctgaattgattttgaaatcaattcttgattatttcttttggaatgaaatacattgtctattactttatgatgacataaatattgtagcttagtttgtggcagtt

SEQ ID NO: 465497 - DNA, 2214 bp, Homo sapiens
  misc_feature (1902)..(1902): n is a, c, g, or t
  misc_feature (2009)..(2009): n is a, c, g, or t
  misc_feature (2056)..(2056): n is a, c, g, or t
  misc_feature (2071)..(2071): n is a, c, g, or t
  misc_feature (2085)..(2085): n is a, c, g, or t
  misc_feature (2090)..(2090): n is a, c, g, or t
  misc_feature (2092)..(2092): n is a, c, g, or t
  misc_feature (2129)..(2129): n is a, c, g, or t
  misc_feature (2139)..(2139): n is a, c, g, or t
  misc_feature (2147)..(2147): n is a, c, g, or t
gaggccccctttagggctgagggctcctctttgccaagcagctcttgtctcacagaccctcgcgccagccctcaattgtcccaattctgctgatgaggacttggagacgtggccaggtacatcacagagctgaggccatgccaagctcggcaccctcccagtcgaggtgcctcccccttgctcccctctcagccctcaaagtcactgggactcatcatctcaagccagaaagtggggccagatggtggcagatccacgggtgtctgttgcatcattaagtgagggtgaaaaatgttgcttgtaattaaacaagggaaccaggacagcagcggcccccgccacagctggggcggctcaggaagggaaggaagactggctgagagtgaggggtgggggaagaagcctgtggaggttgtgacctctgttcctcccctaacatcccagctccacctctgccagctgcatggccttggctccgtcccctcctctctttgtgccttagtttccagacaacagcaagagcggggcttgtcctggtcttgtctcacctgtccccacctcagggcctttgcacttgaggtgccccctccctggcaggtgcttcccacacccagatcttcccagggaggcccctccacctgctccaggtcacagctcaactgcctcctcctcctagcggcttctcgagctctcccatctggtcacctgcttctgttttctccacagcttggcttggtgccctgcacacagcttctcccacactgctcttagccccacagatggcagccgagaggtggagcggaaagtatgacccagtggacaggggtgacctggtgacgaatccctagacagcgcagatgaggctgtggggcagcaggcgagtaatctgtgggcccttcggcatcttccacccaggccctgtcagcctcctgtttttcccctctggctccaggagattaaagtcctccaagaaatgcagctgcttccgtgacaagagggaattatcatcttcggactcaggagacatcctgtggccacggctccctggtcagcagcaggccctgttgaatgggcaggcactgggagggaggccggaggtgtggctcctggagtctcacagctgctgctgtgtcctacagttacaacctgtcctgctgctgagccccatcccagggtggggcgagacggaggggcggtgccgaggggagaggcagcgcagagggaaggagcggggcgaggagaaggggcggggcgagtactgctccaagatatggcaaccgtgacagctttgcgagtagctccaggtcccctgctgctccgtgagaaatcaaacttctggcaatgacgaagcatgaagccagcatctcagggagaggggcggggcgcagttcttgcgggaggagcggggcggtgcgctcctggccacgcaggctggaaactgtagctctcaacggttccccgcccgttggtggcaaggcggctggactagaatcctagcaggcgatatgcgagaaggcgggcagcccaagagggttgggcagggcagtgtggatctcgccgcttccacagcgatgctggctactgatttcggacacctccttgccatgggatggaaattaatgttatgactggataagacaattgtgaagaaactgcacttcgaggttgtctgtctccgtattccgatggaaaaggctggactttagaagcattgctcgctccttcagtttctaacaagtcagttcttggagatactaggaagccaagagtttcctccaggaatggagattccttggaagtgaggttcaccttgagtcaagaaagacgaatcacacacggtcaaaggcaattgcccagggtctcaagaacagagccagaaagaagagctggggccggcgggantgtgggggtcctctctcccacctgaaaagctacagctgcctgccgatcctctcaagaggagacctctctgggctccagcacctaaaacagacaaactgggaggatgnttctctcttctgtgtcacacgtgtcctggagaaaacccatgtatctngaatgaccaaagaanagtatgagaaacangtgcnanaatctgtgccagggcattcagtgtctggctgggggcnctgggggtgncacatgcnttcccaggaagactgaagggggccaagcctgcaggaaatgtcccacttaaactggctttttaaccgg

SEQ ID NO: 465498 - DNA, 3025 bp, Homo sapiens
aagggccagagctcagagggcagccatttttcaccacagagactgtgtcatcatgagagtggtaggcactgacatgactccctgagccagcaggggaggggacactgagggagaagcgcacagggctgaggatctctcgggcccttactctctttatccggctcttttgcaaacatttcccatgatattctcccttcaccgtcacagtccttatgctcgtttcccaaaagagcttctccgatgatctctcccaggttggccgagtgagcgggcctagcctgcgctctcaccccagtgccaccccagtgggagcgccgcccgcgcccgccccctcgccccgcgcccgccccctcgccccgcgcccgccccctcgccccgcgcccgccgctccggcagcccaaacccagacgctaaagcgccgaactgggtttccgggcgctggaggccgcggtcggcctcgtactaggtgacggcccatcccgcgcgcgcaagcccggaaccccgctccgctcaccctccgcgcgctgccgctttgccctggcaacggtaaccacggcgaggccctgccccacgcccggtgattgtgcgcgcggccccgcccccgaggcgcacgccggcccagcgcccacagctgcggcggcctaggtgccgcgtggggcaagcaggtgcctcgcgtccaggcggctccgcggctggctgcctcccgagccggccgcgctcctcccagcgaggcgtggcggggaggcgtagtgaggctgggcccgtggcggttccctgaggagggccgagaaggggccgggggtgctaggggaacgggcgctgggggcagcggccccggtggatgctaagggcttcgggatcgggagagtccaccacgcctgcctgctcggctgagaatcgccatgccagctaaagggaaaaaaggaaaaggccagggcaagtctcatgggaagaaacagaagaaaccagaagtggacattctcagccccgcggccatgctgaacctctactacatcgcccacaacgtcgctgactgcctgcatctgcgaggcttccattggccgggtgctcccaaaggaaagaaagggagaagcaagtgacagcatttcacaacacatctctgttacagacaacaggacctggggaagagaagtcaggataacacaactgttgccagcaacatagactttactccagacgacttgagatgcaaattaagtgtgcttttctgtgatggtggaagatcaggaaatgcaccttacttcctctgttatgccagatatggttagccactttggttttttaggagctataggatgggaaaagcctgagtaattcctacacagtgtgctgaaattaatagaactttcagaaattattataattctgggtcaggattaaactttgctctcagaaggcagttctagttgcattaattgttttcttttgccaaagagcgtttgtcatttagagaagacacggcaagaaacactgggtttccttaggaacattcctctcttgggcaccatttccttttttttttttaatggaaaataataaatactttgtttctataattttcttctcagcagtctgactctgtttgatttgaattagccacaggctccacggatgctaagatggtcacgaatgctctgaccctgccagtcttgcaagcagatgggggcgtcctgcgcgtcacctgtctgcctcttacattaggagcccaagtgaagatgagcacgccaacgggcctggggagcaaacagcacaggagccccagagacattgtagaagcaatggaatgggtccttgtcatccatgaggagcacttttgcagaccttcaggaatccccggctttaagagcatcacccattgggctgaaggtgctgcgggcggtcgacgctcccttgctaaacgattcatttccctgtcagcaacctggatgcctgaagcacacgttcctgccaggcctctgcagtaccccaaatgcctgagggcaaagactttcaaattactcgcagtcacaagtttgggttgggacacaaacaggaaggtggtgtcaaatatgagttctgattttgagcccaggtaccaaagcttgctctgtgagaatctccacataaccattgaagtttgcaacaccccaaaccccaccactttgctcctggtatcagagagcccagttgaacataactgtgtagaggtgttggactcagtttattctagcaggcccgacctccgagaccatctttggacatcagtagactgggagctgtacgtggacgggagcagcttcatcaacccacaaggagagaggtgtgcgggatatgcggtggtaatcctggatgctgtcattgaagccaaatcattgccccagggcacttcagcccagaaggccgaactcattgctttaatttgggccttagagctgagtgaaggtaagactgtaaacatttacactgactctcggcaaggtccaaccgtcctgtctggcatacaagcttatggagaagccccctttgaagatctcaatatagacttcaccaagatgcccaaatgtggcagtaacaagtatttgctagttccagtgtgtacatactctgggtgggtggaggcctatccaacacgaaccaagaaagctcgtgttcttctccgagatctcatcgctaggtttggactgcccttatggatcggctcagaaaatgggccggcgtttgtggctgacttggtacagaagacagcaaaggtgatgagtgtggatcaaagactggaacgtagcccccttgcagccacggtggaaaggaccccagactgtcatcttgaccactcccacagctgtgaaggtagagggaatcccagcctgggtccaccacagctgcgtaaaacctgcagcaccggagacctggtaggtgagaccaagcctagacaacccctgcaaagtgactctgaagaagtcgacaagccctgctccagtcacacccggaagccgactggtccactcatggccgaagcatgaggaaa

SEQ ID NO: 465499 - DNA, 1419 bp, Homo sapiens
aagggccagagctcagagggcagccatttttcaccacagagactgtgtcatcatgagagtggtaggcactgacatgactccctgagccagcaggggaggggacactgagggagaagcgcacagggctgaggatctctcgggcccttactctctttatccggctcttttgcaaacatttcccatgatattctcccttcaccgtcacagtccttatgctcgtttcccaaaagagcttctccgatgatctctcccaggttggccgagtgagcgggcctagcctgcgctctcaccccagtgccaccccagtgggagcgccgcccgcgcccgccccctcgccccgcgcccgccccctcgccccgcgcccgccccctcgccccgcgcccgccgctccggcagcccaaacccagacgctaaagcgccgaactgggtttccgggcgctggaggccgcggtcggcctcgtactaggtgacggcccatcccgcgcgcgcaagcccggaaccccgctccgctcaccctccgcgcgctgccgctttgccctggcaacggtaaccacggcgaggccctgccccacgcccggtgattgtgcgcgcggccccgcccccgaggcgcacgccggcccagcgcccacagctgcggcggcctaggtgccgcgtggggcaagcaggtgcctcgcgtccaggcggctccgcggctggctgcctcccgagccggccgcgctcctcccagcgaggcgtggcggggaggcgtagtgaggctgggcccgtggcggttccctgaggagggccgagaaggggccgggggtgctaggggaacgggcgctgggggcagcggccccggtggatgctaagggcttcgggatcgggagagtccaccacgcctgcctgctcggctgagaatcgccatgccagctaaagggaaaaaaggaaaaggccagggcaagtctcatgggaagaaacagaagaaaccagaagtggacattctcagccccgcggccatgctgaacctctactacatcgcccacaacgtcgctgactgcctgcatctgcgaggcttccattggccgggtgctcccaaaggaaagaaagggagaagcaagtgacagcatttcacaacacatctctgttacagacaacaggacctggggaagagaagtcaggataacacaactgttgccagcaacatagactttactccagacgacttgagatgcaaattaagtgtgcttttctgtgatggtggaagatcaggaaatgcaccttacttcctctgttatgccagatatggttagccactttggttttttaggagctataggatgggaaaagcctgagtaattcctacacagtgtgctgaaattaatagaactttcagaaattattataattctgggtcaggattaaactttgctctcagaaggc

SEQ ID NO: 465500 - DNA, 549 bp, Homo sapiens
tttttgtgcttctagaagagacagggtttcaccatgttggccaggctggtctccaactcctggcctcaagtgatctgcctgcctggcctcccaaagtgctgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccagcgtgctaggatctcaggcgtgagccactgcacctagcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattgtaaaagtgtggttattggaagtttcctctttttagatacaggtgtgagccactgcacccagcctgaatttctccattcttcccacacaccctcctcaggttctccttcct

SEQ ID NO: 465501 - DNA, 222 bp, Homo sapiens
caaactcctggcctcaagtgatctgcctgtcttggcctcccaaagttctgggattacaggtgtgagccactgcacccagcctgaatttctccattcttcccacacaccctcctcaggttctccttcctgaccgctgacccttcttttcttttttcttttctttttttttttttttggagtgcagtagcgtgatctcagctcactgcaacctcttcctcccag

SEQ ID NO: 465502 - DNA, 1375 bp, Homo sapiens
tttttgtgcttctagaagagacagggtttcaccatgttggccaggctggtctccaactcctggcctcaagtgatctgcctgcctggcctcccaaagtgctgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccagcgtgctaggatctcaggcgtgagccactgcacctagcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattgtaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccactgtgtgctccgctggagactctgctcattctgggggtgcggttgacggctggtcgtgatctttcccgtaatctgtcccctcttacggaacctagtcttcgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatgactgagttatagagtagctgtatcattttacattcccaccagtaatgtagaagagatccagtttctctgcacacttgccagcatttgaataatcagtatttttaatttttgccattctaggttatttaaaaacaaaaaaatatatgcaacagagtccatatgtaatctgctaagtctaacatatttactatatggtgtttacagataaagtttgcagatgaatggaaagaaaacctgatcttcttttttgggg

SEQ ID NO: 465503 - DNA, 1454 bp, Homo sapiens
aagggcaagaaagtgtcatttgaactcagtgacttagggaaatatatcttggcttcaggctgtggatagagattttcaagcacatctaggaagtatttcaaaaggtaatttaggaaaaatttcaaaagataatctttaggcccttcacatgctcctatcttccaggttctggaagcagctatcgcaagtgcttaaatgttcctcctgtgactctgtgactgtccaaagtccctgtttccagttcagctttctttgaaaagcccttgagctttaatatcaccatcatgcctcattaaaactcctattcactgggtgcagaagactgcttattactgaaagtaatttgactaaaacataaatactgcaaaatctgtctacatacgtctctttgaaacaacctgaactcttctctcaatataaaattgaggtgaaataccaaattaaggcacatgggtccgttattgccaaagtgatggatttcctgacaaccattccacccagaagattttttttcccagaactaataatcccatccccgttgctggtgattaacttaataacgagcatgacaatcaacaaacagattgaaaaggcaacctactcagaatgggagaaaatatgaaaccatataccagagatgaaagtaatatccagaatatataaagaattcctacaacttgataacaaaaacaccccaatctaaaaatggacacagaatttaaatagacatttctccaatgaagatggccaccacacatgtgaaaagatgctcaacatcactaatcatcaagggaaatgcaaatcaaaaccacaatagcacaatgagatatcatttcagaccccgtatgatgttaggatggctactttcaaaaaaacagaaaataagtgttggtgagaaaccagggaaaaagaaaatatttgcctttaagctctggagaagagctatcctctccttgactgccccttcgagtcctcagagtgggaagattaaaatggcaattgcaatggaattgaacttaatgcgggaaccacagatcctgtgtttctacaaccttagaggacgaattgaaatcagcatagataaacctggagtattgaggactgggcaatcaggaatatttaaaatgcgaataagcttcttgtctttaaaaatgtttttaagaagagttgcagtggtttcgttcacttagtctattttgtggattcaaagggacatttaagaggacagcatgggtgtcccctattatatcgttgtgttaaaaggagatgggcctggagtcagactgcctagatcccagctctgcctctcattagttgtgtgaacttagtcaaagtactgagatttcaaagctcagtttcctcttctgataaataaggataagaagagaaccttagagaactgttatgaggattaaataagataatgcatgtgaaattgttagcataggctttac

SEQ ID NO: 465504 - DNA, 704 bp, Homo sapiens
  misc_feature (3)..(3): n is a, c, g, or t
  misc_feature (5)..(5): n is a, c, g, or t
  misc_feature (7)..(7): n is a, c, g, or t
ctntntncagctaagtttttgagagctattgagtcagtttacacaccctgataaccattggagaacaagtatttgatgctatggttaagcatcaaactgtgtgcctgaagagtcaaaccaagtgggagggagcagagacctctgaggccccccgtggtcattcctgtgatcgacacaaagatgtgccacaaggtcaaggaaggacttgtagcccagccctgggaagtgtggtcagcagacagcctctagctgtccgcaacttcaaggtcagcctcagctgtagagagctgctccctcgctggaggtgtctgagccagtcagagccttggccttgctctgacccacagccacaatccaacatgaagatggttcaagagaccttagaccagggaagtgccttccaaagccaaatacaggagcatgagagaagctgtgtcgtgatggaccgcacccatccttcccactctgtgttctctttgtcctgactttattgatggggtgaggtggacttcttgtaaatccatcagaaagatatctgaagcatacctcggggtatatattaaatctaagaacctgatgtccttttactgctgcccctgaataaaaattatgcatctgtttccgcacttgaccatgtctcagatttgctgattttctttgcttatgctcatcttgccaagttttgagggaatgggcacttctcc

SEQ ID NO: 465505 - DNA, 711 bp, Homo sapiens
ctgagagccgcttggcctgggccctgcacctcgtcccactctgcatgaactgcctttgcgggtggccaggcctggctatgaccgcacgggagagcagggcggaccccgcgaacggggacagcacctgacggcgacatccacaaacgccgccccgcaggagcacgcactcccacacaaagcgcctgcagctgacagccgccgggaggggacatctggacagcctcacgcagctttcagacctgcagtccatgttaaaaggatcttgtttccaatttgccttaattaaacaaacattccaaaccacttcctctcagtctgaccattgttcttcattccatggtactcggagtcctgggaaccactcatcactgtcgggtgcaggtggacgtcccctcacggtgctggcctctcctcggatattccgccatgtgctcctgggggcggagggtcccccaagggcagagctcagccagcaccaccctgcccactcttctgtaaagtgcccctggcacgacgctcccagagaacccaaggatgcgcccagaatgctcccagcaaccactgagggggccctgctgggagacccgcaaaactgccaatgccttgtaggccagcagccgcacgcgccttcagtgctggagtcacgcccaggggctgacgggccagatggtctctgagtgcagcaaattccgtcttgtgagggaaagtgat

SEQ ID NO: 465506 - DNA, 772 bp, Homo sapiens
aggggtatcctgggaagctgaaaatgcatttgtcaagctcagccgtcacagaccgtccttgcagaccggcgctcccctccacaaaccttctgcagcctgtactgctacagcacgaggctgcagaatcagttgtgaaaatagaagccttctaccgtctcctgaagctggtttcatatggtggtttagatttaaatagtgattgtctagcaccatttgaaatcagtgttcttgggggagaccagctgcgctgcactaccaacagcaaaagaagtgaatgggacagctctgaagtatttgaaagcaacagcaggatggctgtggccttgcaccgaatggccaaccctgcccactgtacggaaacaatagatgctgccttagaagggagcaagctggcactgccctggtatgtggatgctggtgggatggagctgcagtttgtgtctctgaagcagattaaacactgtctgccccagcctgtcttaactatcttctcactggttaacagtccttggaagaataaacaatccacacaagctctcagaaagcagaagttccatgattcgtgaccagagtctcatagcacagaattcatctctaaaaacagagacagagtcttgctctggcacccagattggagtacagcggtgcaaccacgactcactgcagccttgacctcccagcctcagatgatcctcccacctcagtctcccaagtagtcaggactacaggtgtgcaccaccacacctggataattattttttaaaacttttgt

SEQ ID NO: 465507 - DNA, 987 bp, Homo sapiens
gtagtatgtagttgatgatgggagtggttatgagaacaatacagccaagaacaggattagagggtgcggtgggaggattgctgccgttagatgttcccttttgatgctaccagtgactctacctactctccacctaacagcgtaatcgcctgctctgggcccatgagacttgctcaagcattttttagcagctacatgactcactatgaccttaatttgcaggtttgcatcagtgtggtacagccaggctgcctctgctgcaagaattctaaagcagaaaccctagatgcaatcagtccacaaagggtgccggcagggcaccagtgctcatcagtgcttgttatgtgccagccaccctccctgtgtcatcgcatcctccccacaccgtcctgcgaagcaggcattagcatccctgtttacagtacttacttggttgtcacagaaaggttcttttacactggttccataatttatgtaatgtttaattaaattttctattttcatcaacaaatataaccatcctaagcagttttggaaatgaccccagctgactcttggtaagggtaacactgagtgtgtggaagcagaagaccatgggtgtgcgggagcaagcctgcccagtgtggacatagccgtccgctggcatcacttactgagggacagggtggcatgcagttagctcgctggcagatcacttaagcggaggtcaataacaggtttgccaggtaggtgtcgttatccctgttacagatgaccaagcggaggtgtgggaagaacaagttccttgctcacagccgcgttgctgaaagcggcaaagctgattccacagtctcaggcatttcactacctgcagactctgccctgtgggagccagctctgtctgaggtgagggagtagaggcaggcccacagcctgcatgagaaggagcaggcctgagttgagaccctgttccctctcctcactttggtattgtcttggatcctccgg

SEQ ID NO: 465508 - DNA, 3943 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggtgatggcagcagaagagagtgcggggtccagggaagggcgagagaggacagccggctttccgcacactgctgccgcgaggcgccactgtgtgtgcaccatggggcgagggtcttgggtggctcccaggggccagttctgccagagtcgaaatttggtggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcaggtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgca

SEQ ID NO: 465509 - DNA, 4037 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggtgatggcagcagaagagagtgcggggtccagggaagggcgagagaggacagccggctttccgcacactgctgccgcgaggcgccactgtgtgtgcaccatggggcgagggtcttgggtggctcccaggggccagttctgccagagtcgaaatttggtggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcaggtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaaactggaatccaaaaaaaaaaccaacaacccgaaaa

SEQ ID NO: 465510 - DNA, 3108 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgaccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgca

SEQ ID NO: 465511 - DNA, 3450 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggtgatggcagcagaagagagtgcggggtccagggaagggcgagagaggacagccggctttccgcacactgctgccgcgaggcgccactgtgtgtgcaccatggggcgagggtcttgggtggctcccaggggccagttctgccagagtcgaaatttggtggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcaggtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcaggctgtgagagtagccgtcacgtgtctcttcccagcagcgccgggcaagtgggtgctagagtctgagccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaaactggaatccaa

SEQ ID NO: 465512 - DNA, 1254 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagaagaaagaaaaagggaagtggtaagaacccagagaaccgaggtgctcccattgatagaaagaaagaccagaatgggtaaaaacaggtatgagaagaagagattatccttttcctcctgagttttcaaaatcgtatttgatgtctgcagtaaaaattaccacaccatctgctgtggtattccataaaagaagagaaaagaccaccattatacagtcatgtgccacttcaccatggggacacattctgagaagcatcataaggccatttcatcattgtgccgacattccagagtgcatttacaccaacccagacccacccaggccgcctggcacagcctcctgctcctggaccacacacctgcacagcacgtgactgcacttaatactgcagccaactgtaacaccatgataagtatttgcatatctaaacacagaaaatacacactgaaagtatagcatcaaggtcaatggcacatccgtactgg

SEQ ID NO: 465513 - DNA, 297 bp, Homo sapiens
aagctgacttcaacctttagttaatgagacttatgtaattgtacctgatgtttaggggaaagagataattgcatgaaatcagagatttactcaaaacacaaacttgcaggagatttcgcatcttctaacacctttgccgctcttgttcccgcaagtagactccccaatttctgcccaggacctcttgtcccggattaaacaggaggagcatcagtgcgtgtgggatcagcaggatttggcagacagagatattcccacggatcccaattcagcaggtgagaacaaggtcagaatgaa

SEQ ID NO: 465514 - DNA, 298 bp, Homo sapiens
acgggggcctggcagaagaaagacgacatgtagcatctgattagttgacccctgttcccagctgacttccccggctcacacaaggtctcatcctgggttgtcgctttctccctctgcatacaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatg

SEQ ID NO: 465515 - DNA, 3969 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcagagtctctcatctcagcacatgacattttgtcatggatcaagcaggaggagcagccatacccatggggaccacgcgactcaatggacggagagcttggattagactctggccctagtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaaactggaatccaa

SEQ ID NO: 465516 - DNA, 3017 bp, Homo sapiens
aaggggaggtggtggggaggaacaggcaggaggcgctagattaaccgcttgttggcttaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcagagtctctcatctcagcacatgacattttgtcatggatcaagcaggaggagcagccatacccatggggaccacgcgactcaatggacggagagcttggattagactctggccctagtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgca

SEQ ID NO: 465517 - DNA, 3846 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggtgatggcagcagaagagagtgcggggtccagggaagggcgagagaggacagccggctttccgcacactgctgccgcgaggcgccactgtgtgtgcaccatggggcgagggtcttgggtggctcccaggggccagttctgccagagtcgaaatttggtggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcaggtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaaactggaatccaa

SEQ ID NO: 465518 - DNA, 1847 bp, Homo sapiens
  misc_feature (2)..(2): n is a, c, g, or t
  misc_feature (7)..(7): n is a, c, g, or t
tntgcanaattaacagtaatcaagcccacagtccaggtcctcgcatagtttgggcctttaaagtcggccatcccagattgagggggcctgacccctgggcgaggccgccgcctctcagttttggggcggtggcgaccccagtccgggagtggccccggtaggtccccgcaggcgggcaggagctccgaggccattggctggcgcgcgggctgccaaggggcggggagcgccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcaggcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaaactggaatccaa

SEQ ID NO: 465519 - DNA, 2266 bp, Homo sapiens
  misc_feature (1)..(1): n is a, c, g, or t
nttcaagagtctgcttcggttgaggctttgaagatgagcacacaggaagaactgcaggagctgcgggaacgctaccatttcctgaatgaggaataccgggccctgcaggagagcaacagcagcctcacggggcagcttgcagatctggagaagcctgatcctgaaatgcagttgttacggcagcagctacgggatgctgaagagcagatgcatggcatgaagaacaaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgaggtaaccactgtcagggaggcagggtttcctctggcagcccctggagccatagaggtcatggccacttcatagaggctaaagagagggacaaagcagggagaatatgcacctcagaggctgggcagtctgctccatccctgatgacatttcccaagtgcccgtggagctggggtttactagtcatcaggacttctctcatcgaatgatttctctctttctccctttgccacttctgttctcttttgctttgtgttctagaccacttctgtagaactgtatttttgcatttgccaatcttctttcatca

SEQ ID NO: 465520 - DNA, 2703 bp, Homo sapiens
  misc_feature (1)..(1): n is a, c, g, or t
  misc_feature (3)..(4): n is a, c, g, or t
ntnngcagactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacaccataggtccatggagtcagccaacatcctcctctatgaagttggagggaatatcaatgagcatcgcctggacccagatgcctacctcttagatctgtaccgtgccaacccgcatggcaaaattgtttcgaaagtggccctacaatgtgtagtagcagcagcaccagagacaaaaccaggagagctctgtgaccttggacaagccccttgccctctcagaatcctttcaggatgaggggctagggcctcagggagaggaagccaagattgtagccatgaccagccccgggagaaatggacagaggaagactttgcttcacagctctcatgctttacatgttgatttgtacaatcttgtcattttgtaatatgatataatatgtaaacgtaattgtttaaacagtaaaggcacaacaagttcaatgtcacatttactttgcctgtttttctctccagtccagtgctcggtaggtgttgtccttccagcgagttgacgtgggagcttggtgacgagagcatcttgctgagctgctcaaagggctctggcccatgtgatccagccacgccttgaacccacaaccaccgggggcgggagggcaggaagagaactcagaatggggaggcatggagtaatgatacccattgctgaagggtgggggcattgcagggacagcctctctgggaatcctctcatctcctacagtcccaggtctcacccttcctcttctcctctgccctgggtctgtatcctcaggccagatactgatgctgatggtgatggtgatgctgctgatggtggtgatggtgatgctgctgctgatgatgatggtggggataatgatggtgatgctgccgatggtgatggtggtgatgatgatggtgatgctgctgatggtgttgatggcgatgctgctgatggtgatgatggtggtgattacgatggtgatgctgctgctgctgctggtggtgatcctgctgatggttttgatggttatgatgatggtgatgctgctgacggtgatgatggtgatgatgatgatggtaatgatgatgatggtgagggtaataatggtaatgatggtgatggcgatgatggtgataataacgatgatgctgatggtgatgataatgatggtgatgctactgctgttgccactgatgatggtgatgatgccaagagcttgacaagtttgatcttcacaataatccagtatcttagtttgggcaatgatggtgatgatggcagctccagagttgctacttctgttcaccaatgtcctctctacctcccatggtctacctacaagccttttggacctccctccaaaatatactccaatccatccacttcactcctttgttcctactaccatcctaatccaaactactaccatctcgatgccttggataatagtgatcatgatggtggtggtggtagtggcgttgatgatggtgatggtaatggtgatgatggtggtggtggtgatggaaatgatgatgttagttgtggtgttgatgatggtaatgataatgattgtgatggtggtgttggtggtgctggtgatgataatgatggtggtggtggtggtggtgatgatggtggtggtggtgatggaaatgatgatgatgttagttgtggtgttgatgatggtaatgataatgattgtgatgatggtggtggtggtggtgatgatggtgatgatgattatgatggtggtgttggtggtgctgctgatgataatcatggtggcagtggtggtgatgatggtggcggtggtggtggtgatgatggtggtggtggtggtgactgatgagaatgatgataatctaaaatagttaagagtttacatcttgacaccagatggtgcaaggccttgatggcctccatgcctcttaactgctctcccttcttgctttcctctctattcatatatagcagctactgtgggcctttaaaaatataaattcaatcttactgaaagccctcctgctgaaaactttccagagggatcccattaaacaaatatcccaactctttaccctggcctatgaagccctatgtctgtgacaccacttcactcatactccctcccaccttactttgcagagccagtcagtcacatgagcctccttccaactcctcagacatcccaagttcattcctgctttgggcttttgcacctgctgttctctctgtccacaacactcttcccccagctacttccatggccagctcctttcgcctttggatctcaggtcagatgtcccttcctttgagaggccatctctgactaccctatctgaagttgcttcttctgtcactctctctggaattgccttggtgaattttcttcctagcatttattactatcctaaattatcttattgagtcagttttttattttctgtctccctgactaggatgtagccccatgaaggcagagactatgtgggcttttctcacttctatggatatgatggatatgatgtggatataatggtactagcagatgctcaataaaaat

SEQ ID NO: 465521 - DNA, 517 bp, Homo sapiens
gcaagggcactggtcttcagtacatctgtgtccgtcagtcatcgaccgtgggcttcccaggggaaagggggtgtcacttttctggcaaggcatcttccctcagcggagctcagttctccagcaaaagaagtagctgtgagctgtagcagtcaagatgcatacagccaggggacagtgcactgcctggtgaagggctctgtgcaggggaacagcatctcctacagcctcccactcaacctccttcaccccttcttcccacagatgagcatcgcctggacccagatgcctacctcttagatctgtaccgtgccaacccgcatggtgagtgggtccttaaacagaaccccacctaaaccctgcgagtctcaggagcagcctggatgcctcctcctctcccctgctggctctgtgtccatgtacccagcatgagaacaaagctattccaggggagggtctgagttttattccaaggcttccttttctgaaatgcctctcagacccctcagaaatagactca

SEQ ID NO: 465522 - DNA, 3228 bp, Homo sapiens
  misc_feature (1)..(1): n is a, c, g, or t
  misc_feature (3)..(4): n is a, c, g, or t
ntnngcagactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacaccataggtccatggagtcagccaacatcctcctctatgaagttggagggaatatcaatgagcatcgcctggacccagatgcctacctcttagatctgtaccgtgccaacccgcatggtgagtgggtccttaaacagaaccccacctaaaccctgcgagtctcaggagcagcctggatgcctcctcctctcccctgctggctctgtgtccatgtacccagcatgagaacaaagctattccaggggagggtctgagttttattccaaggcttccttttctgaaatgcctctcagacccctcagaaatagactcaggggtggtgctctctccactcagaggggatgaggggctagggcctcagggaggggaggccaacactgtagccatgatcagccctggaagaactggacagaggaagaacttcccttcacagctctcatgttttaaccgtgcacacaatgccctcactcccctccaccctccagccctccagagagttgcttcctacaccaagcttgctgtatgacgccaccacttggggcgcttggatctccatgggcttctgtctgtggcttccagactggaggaaaattaaaaatgcagtacctttatcaagaggtagttggggtcttttccccccaggcaaaattgtttcgaaagtggccctacaatgtgtagtagcagcagcaccagagacaaaaccaggagagctctgtgaccttggacaagccccttgccctctcagaatcctttcaggatgaggggctagggcctcagggagaggaagccaagattgtagccatgaccagccccgggagaaatggacagaggaagactttgcttcacagctctcatgctttacatgttgatttgtacaatcttgtcattttgtaatatgatataatatgtaaacgtaattgtttaaacagtaaaggcacaacaagttcaatgtcacatttactttgcctgtttttctctccagtccagtgctcggtaggtgttgtccttccagcgagttgacgtgggagcttggtgacgagagcatcttgctgagctgctcaaagggctctggcccatgtgatccagccacgccttgaacccacaaccaccgggggcgggagggcaggaagagaactcagaatggggaggcatggagtaatgatacccattgctgaagggtgggggcattgcagggacagcctctctgggaatcctctcatctcctacagtcccaggtctcacccttcctcttctcctctgccctgggtctgtatcctcaggccagatactgatgctgatggtgatggtgatgctgctgatggtggtgatggtgatgctgctgctgatgatgatggtggggataatgatggtgatgctgccgatggtgatggtggtgatgatgatggtgatgctgctgatggtgttgatggcgatgctgctgatggtgatgatggtggtgattacgatggtgatgctgctgctgctgctggtggtgatcctgctgatggttttgatggttatgatgatggtgatgctgctgacggtgatgatggtgatgatgatgatggtaatgatgatgatggtgagggtaataatggtaatgatggtgatggcgatgatggtgataataacgatgatgctgatggtgatgataatgatggtgatgctactgctgttgccactgatgatggtgatgatgccaagagcttgacaagtttgatcttcacaataatccagtatcttagtttgggcaatgatggtgatgatggcagctccagagttgctacttctgttcaccaatgtcctctctacctcccatggtctacctacaagccttttggacctccctccaaaatatactccaatccatccacttcactcctttgttcctactaccatcctaatccaaactactaccatctcgatgccttggataatagtgatcatgatggtggtggtggtagtggcgttgatgatggtgatggtaatggtgatgatggtggtggtggtgatggaaatgatgatgttagttgtggtgttgatgatggtaatgataatgattgtgatggtggtgttggtggtgctggtgatgataatgatggtggtggtggtggtggtgatgatggtggtggtggtgatggaaatgatgatgatgttagttgtggtgttgatgatggtaatgataatgattgtgatgatggtggtggtggtggtgatgatggtgatgatgattatgatggtggtgttggtggtgctgctgatgataatcatggtggcagtggtggtgatgatggtggcggtggtggtggtgatgatggtggtggtggtggtgactgatgagaatgatgataatctaaaatagttaagagtttacatcttgacaccagatggtgcaaggccttgatggcctccatgcctcttaactgctctcccttcttgctttcctctctattcatatatagcagctactgtgggcctttaaaaatataaattcaatcttactgaaagccctcctgctgaaaactttccagagggatcccattaaacaaatatcccaactctttaccctggcctatgaagccctatgtctgtgacaccacttcactcatactccctcccaccttactttgcagagccagtcagtcacatgagcctccttccaactcctcagacatcccaagttcattcctgctttgggcttttgcacctgctgttctctctgtccacaacactcttcccccagctacttccatggccagctcctttcgcctttggatctcaggtcagatgtcccttcctttgagaggccatctctgactaccctatctgaagttgcttcttctgtcactctctctggaattgccttggtgaattttcttcctagcatttattactatcctaaattatcttattgagtcagttttttattttctgtctccctgactaggatgtagccccatgaaggcagagactatgtgggcttttctcacttctatggatatgatggatatgatgtggatataatggtactagcagatgctcaataaaaat

SEQ ID NO: 465523 - DNA, 1074 bp, Homo sapiens
taaatcctgcagccattagaaagagagtaaggaactgctataaatgcattatactcacacatttgacaacttagaagatatgaacaaattccttgacatttacaagttaattgttgggcttgccattctaccctctatgaccttcccactcattatctcctatctcagtaactttaaactcactcatatgaggccctccatcctgtggtacttcacctgtatttcaagagcaagtcaacaactcattcttccctggaagccattcatgaatttaaattaccaagttgaaataaaactagtattagatttagaactgtgttctgtcaaagtcttttcccttgggaaacttgcctttattatgatcaagtttctgggaatattgcacaatgattactcttctctccctaacagagccatgagatcatcattggatcttcactgtgagaaaccagtggtattcttggaggatattcacccttggaatcaagacaccatactgtgagtatgccaagcagccacatggaaaggccaatagagctgttccaagcacagcctcagctaggtcccaggagatgaccagcatcaagcaccagacaaagtacttcaatgactgtcatcttgtccacatccccagctttcacaagacaggtctgctgtgatttcagcttcttctagttgactctatgatgcttggcttctagcaaatctgcttccttcctttgtccatccatgctgatggatggtaacagcaatagcaagaagctggatttttctcatcattcgttacagtatgtggattctcagatattccaccacctatttaacaaattccatgtattacattatttatgttttaaatactgtaataagcctatcttttgtttccttggttggaccctacctgagtacaaatttagctaaaggaacccagatacatagaggacaaggacatttggagttcatccatcatgtgtgaacttcttatccatctcctaaccaaggtgggagggagcatcattgatcaactgaattttggctagattgctgctcatacatgactcagctggcccttag

SEQ ID NO: 465524 - DNA, 1496 bp, Homo sapiens
cctgtctttactacaatctctgaacataaattgtgaagatttcatggacacttatcactttcccagtcaatactcctgtgatttcctatgcctgaaaaataaccactctcccctatttgcactcacatggcatgcaataaaccatatactgatatattcatgcatacccccaggtagtgcaaatgatctggtgtttgttgtgcttatctctgtgtctttagagcccatcgacattcatgtaatcagctgctgggaacaatttttaatgaatgaatctttgaatgagccttttaagactccatcagcctcgaagttcatttgtgtggcactaaaagtaaaccaaaagcaggaagctaaggatctttcacctctaatgcaccctgaccttggctatttcatgtcagggtctgtgcagtctaagcccaggcagccaacatgcttggaggatacttcatgtagtggtacctacagctctttccagaaggccatgaaaatcgaattacatggtatgtaatcttttacatttgtcttcttccagttatcaagactcatttaagattcatccatgctgtgcatcgagcaatagctcttctttgattgttgatattgcattgtgtgaatgcacacatcttgtttactcattcacctattcaagaatatctgggttgtttccatattttgggaattatgaatatgaatattttggcaattatgaatataaataaagctgctataagcttctgtgtacatgttttttgtatgaatataacttttagtcttcttgagtaaatattatgagagattgttgagtagtatggcaagtgtatgtttgcctttgtaagaaactctcagactacttttcaaaatggccgtataattttgaactcacaccagcaataaataaaatacagacagtcctcaaatgacgatgggtcagtttgtgattttcaactccgcgacagtggaaacatgatacacattcattagaaaccgcagtttgagtacccatacaaccattctgcttttcactttcagaacagtattcaataaattacctgtgatattcaacactttattataaaatagtttttgtgttagatgactttgcccacccataagctaatataagtgttcctgagcatatttaagataggctaggctaagcaataatagctatttgttaggttagatgttgatatggtttggctttgtatctctatgcaaatctaatctcaaattgtaatccccacgtgtcgagggaggaatctgtaatcctcatgtatcagagaaaacagggtggatcatgagggtggtttcccccacactgttctgatagatttctttcctttcatcacttggagaacattttaatgactatattgtgtttcatggtttcaatgaactctttttagccacgatttatgacccactgctgaacactgggaatgttctccagtcatttcctaccacactgaattcgatgaatgtgcacacat

SEQ ID NO: 465525 - DNA, 902 bp, Homo sapiens
  misc_feature (14)..(14): n is a, c, g, or t
ataaatggatacgncaatttcatttcatcagcccgtgcaaaagcctagaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaacactatttgactagcatgattattatatttgtaatgacatatttcatatgagtaattgaaaagtgcaaatatcaagaaataaaaataacttattgacgtctttgttctgaaagacagatggcttcaaggatgctacaattcaaaacctcagtaatgccttgttataaaaacattgtaattattttcaacttgtgaatgaaatatatttcataatttatttgtaaatgacaaaaaacctcaagcataaaaaagagactttttagagagagagaatactaatctatatggtatttttgcatttttgcacaaagagtgaaaagttatatgtgaatatcatttaagaaaataaacatgttttgatcatactgtgcagattgatctgcatgttcatgaatgagcctaagaataaagtatgtgtgtgaatgtgtgtatacatactgtaaatatagaacatgtatacagcatatattatagcatacatgaatgtaaataggtatt

SEQ ID NO: 465526 - DNA, 847 bp, Homo sapiens
ttaaagaatatgaagattattttaatgagcccgcgttgacgtaggcatcgcctcccctctccgctggatagaagcggagaaaggagccacggggagaagcggagtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaaagattgagggctattgaaataaccgacttgcccagctgcccggtggtgcccccgacaccagagttacctacaaggaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaa

SEQ ID NO: 465527 - DNA, 714 bp, Homo sapiens
  misc_feature (54)..(54): n is a, c, g, or t
gcccatatccactcccttccacaccacacacacacctcaatgaacacgctttgnggcatttttgtggaatattgccgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaagaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaa

SEQ ID NO: 465528 - DNA, 2676 bp, Homo sapiens
ttaaagaatatgaagattattttaatgagcccgcgttgacgtaggcatcgcctcccctctccgctggatagaagcggagaaaggagccacggggagaagcggaggtaggggtcgcctggatttctgttgctgcggtccgggggcggggcggatcaaaggccagccaagagtactggtcctggatctacaaatacattaggctttttcctcctccgtcaacctcctaaaccccaatgaggtcatagcaatgaaagagaatcagctcgagagaaaggaggaggaagaggacgacgacgagggagaagaaacccagacggaaagaggccatcagacaaggtcgctttttctggcgacaaagcaactgcaaggagcaactctggacagcgcctggggagcaaggctcggagctccctgggctcctccaggttttccgctgcttaaaagccccggtaccggaagatccttctacgatccctatctgaacgtgccagggggtggagcagctcctttgcctctggcccagccagggaaggtcttcgtttctggaaatccagcccttgtggataatgcctcgctcttgaagaaagaaaagttttgggatctggtagggggtggaaggggtaaggaggatagtggaagaaaaaaaggtagatggttgatttccctctctgatctggaaggaagatgaccgaggaaggatgtgcaccagcggtcagattattgggagcctcttggtgctctccgtgctggagatagggctgggggtgtccagcgtggccgtgggggcgccacagtgaacatctctgaatctataaggttgaatgaaggaaacctttatattgtcattatgtataaactttgttataaaggaaaacgcaaggattttaacttaggagatgcaggatagcattgtaagcaatgccccagaaaatcataatcataataaataataaataaatatgcatgggagagaccagtggaaatacatgtattacatggaaaaattaattaattgaaggaagtaatcctttttacaaatcactcccagttagaggaattgtgttttagataggcatggcatgaaaagtatagtacctgatgggttaaaataaccataagataacaaagaaattgaccctatttaaaaatgtattctgatattttaatgtcctgagacattttctaatatattttgactgttcatacgttatctgatcttgactgaacgaaaagtatctggatttcgtccagatgcaagattctagatgatattaggatagtgtgtgcatcaaggctaaaaaggggtctaaagaggagattgaactacaatcactcagaacagtgaaccagtcaatagcaggtaatagcatctcagcattcagatgaaagtgctaagacgttgtccaactttcagttttgccaaaagggaaaagctattctgcataaattctgaagccaaacctggtgtttgagagaaagtgaatcaactactggaatatattctcttagtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaagaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaacactatttgactagcatgattattatatttgtaatgacatatttcatatgagtaattgaaaagtgcaaatatcaagaaataaaaataacttattgacgtctttgttctgaaagacagatggcttcaaggatgctacaattcaaaacctcagtaatgccttgttataaaaacattgtaattattttcaacttgtgaatgaaatatatttcataatttatttgtaaatgacaaaaaacctcaagcataaaaaagagactttttagagagagagaatactaatctatatggtatttttgcatttttgcacaaagagtgaaaagttatatgtgaatatcatttaagaaaataaacatgttttgatcatactgtgcagattgatctgcatgttcatgaatgagcctaagaataaagtatgtgtgtgaatgtgtgtatacatactgtaaatatagaacatgtatacagcatatattatagcatacatgaatgtaaataggtatt

SEQ ID NO: 465529 - DNA, 1212 bp, Homo sapiens
  misc_feature (54)..(54): n is a, c, g, or t
gcccatatccactcccttccacaccacacacacacctcaatgaacacgctttgnggcatttttgtggaatattgccgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaagaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaacactatttgactagcatgattattatatttgtaatgacatatttcatatgagtaattgaaaagtgcaaatatcaagaaataaaaataacttattgacgtctttgttctgaaagacagatggcttcaaggatgctacaattcaaaacctcagtaatgccttgttataaaaacattgtaattattttcaacttgtgaatgaaatatatttcataatttatttgtaaatgacaaaaaacctcaagcataaaaaagagactttttagagagagagaatactaatctatatggtatttttgcatttttgcacaaagagtgaaaagttatatgtgaatatcatttaagaaaataaacatgttttgatcatactgtgcagattgatctgcatgttcatgaatgagcctaagaataaagtatgtgtgtgaatgtgtgtatacatactgtaaatatagaacatgtatacagcatatattatagcatacatgaatgtaaataggtatt

SEQ ID NO: 465530 - DNA, 1059 bp, Homo sapiens
tgatgagtgcatgtgtaagatcaagattcagaggaagaggagatggtcaagaggaatctgatttggttgcattcatggcttcccagaagcaccagctgcacttcaatgtggcagctattggccacctgtggctactgggtgcatggaatgtggctggtctgaactgcgatgtggtagaaagggcattagggggtggcgccctaaacattatccaatcagggacgcggggctgggacccgtccaatcaggcacgcagctggagcggacaggacggcttccgggatttggcggggcctttgtctctagctgctgcgggagctccaggtctagtctttactgctctgaccacctggaagcctagaaatggtgagagtgcggtccgacaccccgagagagggggaggggctggttggaaccggtcggaagtggctgtggcaggactccaggctccaagcactgggctccaaaatccgcggcccgagttgtccttggcgcagctcggtcctcagtaaaatatttacgaatggtgtaaaagaggtgagtttcagaaaaaaattaatatctacatatattccatttgttaaaaattctcatttactattttgttttccagactgagtttagtaattgtcacaggtagtttttttacggctgggtaattttttttttttttgagacagtctcattctgtcacccaggctggagtgcaccaagattgtgccacttcattccagcctgggcgaaagagtgaaacttcatctcaaaaaaaaaaaaaaaacagaaaagaaaatgaatacatttccaccagaaaatgtggtaggtaattggtgaagttacatagattcttgaaaacattagtacctctttttgcatggtaaatttgtgacagtgaatatttctagtctataccctgttatcttgatttctgagttttatgctaaattttatgagatgaaacttggtacctcctagaagtgtttccaaatgaataattgtttactacataatttttaatggaaataataaaataatacatttattatctaaaaggaatacttt

SEQ ID NO: 465531 - DNA, 883 bp, Homo sapiens
agttcccagtcatctttatccctttaagcatggtttattttctgagcaaggagtcatcatgggagaccttttttccttattttgggaggtagatcctcccccaatacctgtaaattgtgccattccaaatcaggattatgaatgctggaaggatgactcttgtggaaccatagggagcttcctgctttggtattttgttatcgtatttgtcctgatgttcttctctagggcttctgtctggatgtctgaggataaaaaggatgaaggcagtgggacaagtacttcagtaaggaaagcaagcaaagagacttcctgtaagcggcaaagcaaagacagtgcctgggatccctcacaaacaatgaagaaaccaaagcagaaccaacttacccctgtaaccaactcagaagtggctttggtcaatgcctatcctgaacaaagacgagccaggcgccagtctcagttcaatgaggtgaaccagaaccaacatgacagtgatactacggagtatggcagtgaagagtctaactcagaagcctcctcgtggaaggagagtgaaagtgaacaccacccatcaccagacagtattaagaggagaaaaatggctcagaggcaaaggaatctgggaagttaccaaatgagcgaaaggcactgcctccactgcaaagccttgagaaccaacgaatggttggcgcaccattcccgacagaagccttcagtaacaccgccaatgaaaagagacagtcaagaggaaagttccatatctgacattaacaagaaatttagtaaattttgaattttatcacgttcttccttcacttgaagccaaatgaaagagatgaataaaacatgaaaaatcaccagagctataggtgaggagactttt

SEQ ID NO: 465532 - DNA, 3171 bp, Homo sapiens
gctgggtgctggctcaggaggaaggtccgcatcggaatggtggactgtccaggtactggctcaggggggaggtccacgtcacaatggtggactgtccaggtagtggctcaggagggaggtccacgtcacaatggtggactgtccaggtgctggctcgggagggaggtccacgtcacaatggtggactgtccaggtagtggctcaggagggaggtccacgtcacaatggtggactgtccgggtagtggctcgggagggaggtccacgtcacaatggtggactgtccaggtgctggctcgggagggaggtccacgtcacaatggtggactgtccgggtagtggctcgggagggaggtccacgtcacaatggtggactgtccaggtactggctcaggagggaggtccacgtcacaatggtggactgtccgggtactggctcgggagggaggtccacgtcacaatggtggactgtccgggtgctggctcgggagggaggtccacgtcacaatggtggactgtccgggtagtggctcaggggggaggtccacgtcacaatggtggactgtccaggtgctggctcaggagggaggtccacgtcacaatggtggactgtccaggtgctggctcaggagggaggtccacgtcacaatggtggactgtccgggtactggctcgggagggaggtccacgtcacaatggtggactgtccaggtagtggctcaggagggaggtccacgtcacaatggtggactgtccaggtgctggctcgggagggaggtccacgtcacaatggtggactgtccgggtagtggctcgggagggaggtccacgtcacaatggtggactgtccaggtgctggctcgggagggaggtccacgtcacaatggtggactgtccaggtgctggctcagggggaaggtccacatcggaatggtagactgtttaggagaaaggtccacgtcagaatggtggactgttttaagaggaaggtccacgtcagaatggactgtccaggatggtgcatgtgcagggtgtgttctggcaccactgtgtgtgtacagcgaatcgctctctgtaacctggcccctggtgaccagatgcacttacaacatgcaccttgctgcggctagatgcagtctgtggacacagattaagcgagtctgccctgaagtggagtctgccctggagtggagtcgtctgccctggagcggagtcatctgccctggagcggagtctgccctgaagcggagtctgccctggagcggagtcgtctgccctggagtggagtcctctgccctggagtggagtcgtctgccctggagtggagtcgtctgccctggagcagagtctgccctggaatggagtcctctgccctggagtggagtcgtctgccctggagtggagtcatctgccctggagcagagtctgccctggagtggagtcatctgccctggagcggagtctgccctggagtggagtcgtctgccctggagcggagtcgtctgccctggagtggagtcgtctgccctggagtggagtctgccctggagtggagtcgtctgccctggagtggagtcgtctaccctggagtggagtctgccctggagtggagtcgtctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgctctggagtggagtcgtctaccctggagtggagtcgtctgccctggagtggagtctgccctggagtggagtcgtctgccctggagtggagtcatctaccctaggagtggagtcgtctaccctggagtggagtctgccctggagtggagtcgtctgccctggagtggagtctgccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcgtctgccctggagtggagtctgccctggagtggagtcgtctgccctggagtggagtcatctaccctggagtggagtcgtctaccctggagtggagtctgccctggagtggagtcatctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcatctgccctggagtggagtctgccctggagtggagtcgtctgccctggagcggagtctgccctggagtggagtcgtctaccctggagcggagtctgccctggagcggagtctgccctggagcggagtctgccctggagtggagtcgtctgccctggagtggagtctgccctggagtggagtctgccctggagtggagggaagtgaagccagatcgctgaggagtgcgaggaaagctgttggttgttatggtcaagccccagaactcgtagatggatgtccccagcccagtgcctcagaaggtgactgcgtttggaaatcaggtttttgcaggaaaaattggcgttaaccctcagcatggagtggggattggtcccaggacccccacttacgccaaaatcttcacacactgaagtcctgcagctgccccacggaatctgcatacacaaaaagtcagcttctgtacacttggctttcacagccctcaaatactgcatttttgatccatatttggttggaaagatccatgaataaatgagttcagacccatgttgtcccagggcccactgtagttccgatgaggccactgggggctcctccagcacagccaacaccacctgtgccagcatcactgcccttcgaagtgtggccccagcagcggtctcctgcaccctcc

SEQ ID NO: 465533 - DNA, 1062 bp, Homo sapiens
gtcctttcaatctcagacctagtttttcctttctttccattatggtatgtttttctagggcctgtactttcattgctgcagatagctataggccaggtgtccctaacttcagtatctgccaacaagggaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaac

SEQ ID NO: 465534 - DNA, 1750 bp, Homo sapiens
gtcctttcaatctcagacctagtttttcctttctttccattatggtatgtttttctagggcctgtactttcattgctgcagatagctataggccaggtgtccctaacttcagtatctgccaacaagggaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctgtatgtgacccggggcttacacctcctgggggctgtgttggctggctggcccctgaggtgatggggcacggggaagggaagtgtgatccctggtgccagctcatgtttccggggcctggagcccacttattctcttcttcatggggctctgctgggtctctcttgctgagtgtactgaaactctacagatcacactgaggttagagtttcattttttctagtttcagtataagcagcttgcatctttacgtgacttcattggccttagagcaaattaaacatcttatttctatttagccttagtgttgcttctgtctttggaatttttgctgtatattgtctgttttctctctgaaaagcagaagcatacagtgaaagctcactgaaatgagttcctatctgtcctgagtgtatgcttactatccacttgccctgaaaggattctccatttggatttgggcaggttctggattcaacagggttgtagcagggcttaacattgtatttattagtatgtggcattcctattttatctaattataatgcctccagccattgagataagaggatgagaacaactctgaatttttccttctcaaggtccattttctcatctttctgtttctttctctagtacagatgctccttgacttacagtgggattatatcccgataaagccattgagacactgacttcatcaaacttaggtttttgtctttggcaagctatctgccccaatatttgtattcctattcctaagcctggtcattgtcagatgactcatagaagcctttaggagaagccagagtatacctagctctaggagtgcttatcagattaatgacct

SEQ ID NO: 465535 - DNA, 2150 bp, Homo sapiens
  misc_feature (2)..(6): n is a, c, g, or t
  misc_feature (10)..(10): n is a, c, g, or t
  misc_feature (12)..(12): n is a, c, g, or t
  misc_feature (14)..(14): n is a, c, g, or t
gnnnnntttncntnagttccgctttgctgatggactggacatcacactcatgatcctgggtatactggcatcactggtcaatggagcctgccttcctttaatgccactggttttaggagaaatgagtgataaccttattagtggatgtctagtccaaactaacacaacaaattatcagaactgtactcagtctcaagagaagctgaatgaagatatgactctgttgaccctgtattatgttggaataggtgttgctgccttgatttttggttacatacagatttccttgtggattataactgcagcacgacagaccaagaggattcgaaaacagttttttcattcagttttggcacaggacatcggctggtttgatagctgtgacatcggtgaacttaacactcgcatgacagagtatacacagaatctcaaagatgcaaaggattttggcataaaaaggactatagcttcaaaagtgtctcttggtgctgtgtacttctttatgaatggaacctatggacttgctttttggtatggaacctccttgattcttaatggagaacctggatataccatcgggactgttcttgctttagcagatttttctggtcacacatcccagcatgtgataaccacaagactatgagataatcaaaagttgttccttattaggaaaaggccaaggatacttggattaatctgtgtttctattgcttctcggccttttggctaagatcaagtgtaatctgtgttcttttttatttggtcatatcttccattctttcttacctaattcctctaatatctctctgtgagcctaaaccaataattatatattacattctattgtctttcttatataactgcagaaagataaatatcactttgtttgttcctgtaggttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggatacccccaggtattcattttgacctaatttcacctcaagtggagaatcgctgaccttgaaccagcgcccttcgacagctctggcccctcaaacctcaccctgacctcctgctgcctatgagctactgcacatacctcaaggccatatgcagttgtggccctgcaccaaattacactgaatctaggaggggagttggcagtggcggtatgaaaaaccattgaacagttttctcgatggcctgactcccttataaaccagagccttcagaccccttacaaggcttaatggcacattttactttgcatttgcttggaagtgagttaagcgtttttttttctctaagaaaatcgcaggcttctttttttaaaatgctgactttatggaaccagaaacggatactggcaggctaaatgtccactgcttcttgaaaaatctcttagttactattatttagtagcaaatcagattttcctgatattttgctatttgtcatcccccttgacaaaaaagaaagcattctc

SEQ ID NO: 465536 - DNA, 430 bp, Homo sapiens
gtgagtacactgtgcagcctgtgtccttagcttatggtggcagcgctgcgacattccaatataaggtaatgaaacaacaactgatgcagaatagtaggggtgtgattaaattctggattgtcctagaacaagcttgtccaaccagtggcacaagatggctttgaatgaggtccaacacaaatttgtaaactttcttaacacattatgagatttttttgtgatttttaaaatcttatcagctattgttaattttagtgtatttaatgtgtggcccaagacaattcttctttcaatgtggcccagggaagccaaaaaattggacactcctgtatgaaacatctgtagagaagaatgcatagtaacaaccaaaagaagaaatgcatcattgaaaggccagattgaaaagaatcatattttgttctgcaattga

SEQ ID NO: 465537 - DNA, 2060 bp, Homo sapiens
  misc_feature (2)..(6): n is a, c, g, or t
  misc_feature (10)..(10): n is a, c, g, or t
  misc_feature (12)..(12): n is a, c, g, or t
  misc_feature (14)..(14): n is a, c, g, or t
gnnnnntttncntnagttccgctttgctgatggactggacatcacactcatgatcctgggtatactggcatcactggtcaatggagcctgccttcctttaatgccactggttttaggagaaatgagtgataaccttattagtggatgtctagtccaaactaacacaacaaattatcagaactgtactcagtctcaagagaagctgaatgaagatatgactctgttgaccctgtattatgttggaataggtgttgctgccttgatttttggttacatacagatttccttgtggattataactgcagcacgacagaccaagaggattcgaaaacagttttttcattcagttttggcacaggacatcggctggtttgatagctgtgacatcggtgaacttaacactcgcatgacagagtatacacagaatctcaaagatgcaaaggattttggcataaaaaggactatagcttcaaaagtgtctcttggtgctgtgtacttctttatgaatggaacctatggacttgctttttggtatggaacctccttgattcttaatggagaacctggatataccatcgggactgttcttgctttagcagatttttctggtcacacatcccagcatgtgataaccacaagactatgagataatcaaaagttgttccttattaggaaaaggccaaggatacttggattaatctgtgtttctattgcttctcggccttttggctaagatcaagtgtaatctgtgttcttttttatttggtcatatcttccattctttcttacctaattcctctaatatctctctgttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggatacccccaggtattcattttgacctaatttcacctcaagtggagaatcgctgaccttgaaccagcgcccttcgacagctctggcccctcaaacctcaccctgacctcctgctgcctatgagctactgcacatacctcaaggccatatgcagttgtggccctgcaccaaattacactgaatctaggaggggagttggcagtggcggtatgaaaaaccattgaacagttttctcgatggcctgactcccttataaaccagagccttcagaccccttacaaggcttaatggcacattttactttgcatttgcttggaagtgagttaagcgtttttttttctctaagaaaatcgcaggcttctttttttaaaatgctgactttatggaaccagaaacggatactggcaggctaaatgtccactgcttcttgaaaaatctcttagttactattatttagtagcaaatcagattttcctgatattttgctatttgtcatcccccttgacaaaaaagaaagcattctc

SEQ ID NO: 465538 - DNA, 1043 bp, Homo sapiens
aaagggaggcggcacaggcagccaggggactactgcactactgcaatctgcaacgctgccctcggcaacccgggaaacttaaaaggacagcaaagggacagacactctcgtttattccgtgctcactcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatgctggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagccggagtgtacttcactgacacctatggggacagagaccggttcaaggtctctaagaaggtgcccaagatcccactccatgtcaggtgagtgtttgttcccctcttagggagtctgactcaggataaacaatagagttggttcccctcttcaacaagcttccattgcaatacaggtgattttccactcagtttggaaccaccacaaatcaaaagcaggatgattaaaatgcaccaagacacaagagaggctgggccctcactgccactccctcctgtggccaaagctgaatagaaaagcttgtcttaccactttatctccatgtctagtaaatagaacctagagagtgctcatcaatacctctt

SEQ ID NO: 465539 - DNA, 2185 bp, Homo sapiens
ggatctctctcggctgcttttttccactggtaacttctgaggctgagatcagcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatgctggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagccggagtgtacttcactgacacctatggggacagagaccggttcaaggtctctaagaaggtgcccaagatcccactccatgtcaggaggattccctgggagcacccaccagctgagatctgcacatcagccacaatcctctcaggacggcggaaagggaagggctcagctgccagcctggccacagcctgcatcatctcatcccagaggcggagcacaggctcggggtccttcagggcctgaaggtttgtggttggcactgtcaggatgatgttgtccgtggccagctctccccagggagccaggttctcctgcatctgcctcttccactcctccagcgatgtcttacccagcttgtagtatggggcaggcacagctcccctgatagtgacaggcacagggcctagttggctgcccttgggcacgatgacgtagaggaggccgccccagaggcaggagactgaccgctcagtcctgtccatccagcattggtgagtcaccacgggggctcgagatagcttcctggccttggtaaggtcatcggtgtggcagcctatctgtacctggacaggtgattccaccaagcgttggagaaattagagtctttgtgatgctttgtgatgtgcgtgtgaggttgtgtagatggaaggtattagacaaacatgcccatgaaaccccagcttcccttttctatgtgctaggcatggaaacttatgaaattttagcactccaaagtcatttggacttcaaggcatttaaaatcatttttctaaggatttaaacagctccactataagtcttcacctgacatgaattggtgagagacaaggctgatcctggcaaaggtcttgtgtctttctgccaggcaaaatcctgggttcttctagcaggacctaagccagtctggggacgctgatattgaggatgagctgggggactctgctctgtcctctgtgaacacacaggaggcccatccagagtgagtgaggttgattctctctccctttttgcccagagcttccctttctggccgccagatgggtggagatctgttttgtctggagtcctggagttgcttttcttaggtttgatataagcaagctccagaaagaatgctgacagaaaagggaccctagctgtggtaggaagtggccctcagagtcaaggaggcaggatgaatttaaattctgcatgtagggcatattttggggagtgatgggattatgcacacccttcaggtgtcaagataaagagataaaaccagagtttgtgcagaatgagcttgctgacacacagcctaaatttgtaccgcatgtttcatactaactccctctgagtttgcacatgggacccatgaggaggcatgaagaggtaactgcccatgcccgaggattttccagcccttccttttctttctatcaatcacctactaatcacagaatccactccctacaccttttctactaaaataactctttaaaataagtacaatgggacagatttgagctgggctcctgtctccttgttaatcaaattgcaataaaatgttttcttttgtttttgttttttttttggtgaaaaa

SEQ ID NO: 465540 - DNA, 184 bp, Homo sapiens
tgaaagtctttgcttccccctgcagcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgc

SEQ ID NO: 465541 - DNA, 1941 bp, Homo sapiens
gggctggtacggtccggagtgtagggatcgcctcgcctccgacccgtcccccgggcgccactgcagagcctgtccgtcagtccctaggtatccgcactgctcaggggaggattccctgggagcacccaccagctgagatctgcacatcagccacaatcctctcaggacggcggaaagggaagggctcagctgccagcctggccacagcctgcatcatctcatcccagaggcggagcacaggctcggggtccttcagggcctgaaggtttgtggttggcactgtcaggatgatgttgtccgtggccagctctccccagggagccaggttctcctgcatctgcctcttccactcctccagcgatgtcttacctgggaataaatatcatggaacctaccacacccacttctccaacttcccttgagctgaaaaataccatttgaactctggaagaacattgcaataatgaactactatcacaggcgtctataggctgtaaagtgaagaaaaggcttcctgactcttctctttgtctgccctgaagtctccatggacacagggtattccgtatcttctgcctccatgttccctcccaacagttcttcctctttctctccaccaaagctcatccctctcccatttagcaaccaccccacagttcccacggcatctgccactcttcctcctccctaaatgttcactccacttacccagcttgtagtatggggcaggcacagctcccctgatagtgacaggcacagggcctagttggctgcccttgggcacgatgacgtagaggaggccgccccagaggcaggagactgaccgctcagtcctgtccatccagcattggtgagtcaccacgggggctcgagatagcttcctggccttggtaaggtcatcggtgtggcagcctatctgtacctggacaggtgattccaccaagcgttggagaaattagagtctttgtgatgctttgtgatgtgcgtgtgaggttgtgtagatggaaggtattagacaaacatgcccatgaaaccccagcttcccttttctatgtgctaggcatggaaacttatgaaattttagcactccaaagtcatttggacttcaaggcatttaaaatcatttttctaaggatttaaacagctccactataagtcttcacctgacatgaattggtgagagacaaggctgatcctggcaaaggtcttgtgtctttctgccaggcaaaatcctgggttcttctagcaggacctaagccagtctggggacgctgatattgaggatgagctgggggactctgctctgtcctctgtgaacacacaggaggcccatccagagtgagtgaggttgattctctctccctttttgcccagagcttccctttctggccgccagatgggtggagatctgttttgtctggagtcctggagttgcttttcttaggtttgatataagcaagctccagaaagaatgctgacagaaaagggaccctagctgtggtaggaagtggccctcagagtcaaggaggcaggatgaatttaaattctgcatgtagggcatattttggggagtgatgggattatgcacacccttcaggtgtcaagataaagagataaaaccagagtttgtgcagaatgagcttgctgacacacagcctaaatttgtaccgcatgtttcatactaactccctctgagtttgcacatgggacccatgaggaggcatgaagaggtaactgcccatgcccgaggattttccagcccttccttttctttctatcaatcacctactaatcacagaatccactccctacaccttttctactaaaataactctttaaaataagtacaatgggacagatttgagctgggctcctgtctccttgttaatcaaattgcaataaaatgttttcttttgtttttgttttttttttggtgaaaaa

SEQ ID NO: 465542 - DNA, 2239 bp, Homo sapiens
gggctggtacggtccggagtgtagggatcgcctcgcctccgacccgtcccccgggcgccactgcagagcctgtccgtcagtccctaggtatccgcactgctcagggcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatgctggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagccggagtgtacttcactgacacctatggggacagagaccggttcaaggtctctaagaaggtgcccaagatcccactccatgtcaggaggattccctgggagcacccaccagctgagatctgcacatcagccacaatcctctcaggacggcggaaagggaagggctcagctgccagcctggccacagcctgcatcatctcatcccagaggcggagcacaggctcggggtccttcagggcctgaaggtttgtggttggcactgtcaggatgatgttgtccgtggccagctctccccagggagccaggttctcctgcatctgcctcttccactcctccagcgatgtcttacccagcttgtagtatggggcaggcacagctcccctgatagtgacaggcacagggcctagttggctgcccttgggcacgatgacgtagaggaggccgccccagaggcaggagactgaccgctcagtcctgtccatccagcattggtgagtcaccacgggggctcgagatagcttcctggccttggtaaggtcatcggtgtggcagcctatctgtacctggacaggtgattccaccaagcgttggagaaattagagtctttgtgatgctttgtgatgtgcgtgtgaggttgtgtagatggaaggtattagacaaacatgcccatgaaaccccagcttcccttttctatgtgctaggcatggaaacttatgaaattttagcactccaaagtcatttggacttcaaggcatttaaaatcatttttctaaggatttaaacagctccactataagtcttcacctgacatgaattggtgagagacaaggctgatcctggcaaaggtcttgtgtctttctgccaggcaaaatcctgggttcttctagcaggacctaagccagtctggggacgctgatattgaggatgagctgggggactctgctctgtcctctgtgaacacacaggaggcccatccagagtgagtgaggttgattctctctccctttttgcccagagcttccctttctggccgccagatgggtggagatctgttttgtctggagtcctggagttgcttttcttaggtttgatataagcaagctccagaaagaatgctgacagaaaagggaccctagctgtggtaggaagtggccctcagagtcaaggaggcaggatgaatttaaattctgcatgtagggcatattttggggagtgatgggattatgcacacccttcaggtgtcaagataaagagataaaaccagagtttgtgcagaatgagcttgctgacacacagcctaaatttgtaccgcatgtttcatactaactccctctgagtttgcacatgggacccatgaggaggcatgaagaggtaactgcccatgcccgaggattttccagcccttccttttctttctatcaatcacctactaatcacagaatccactccctacaccttttctactaaaataactctttaaaataagtacaatgggacagatttgagctgggctcctgtctccttgttaatcaaattgcaataaaatgttttcttttgtttttgttttttttttggtgaaaaa

SEQ ID NO: 465543 - DNA, 1440 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465544 - DNA, 777 bp, Homo sapiens
agattcttcccacagagggaggaccaccatccacttgagaactaaataagagcatcttaactccttctgtaagggatgcctgcactaaaaaaattgtgtaagtcatccctgaggaatttggctaatgtcagaaagccagttcactttggtgcatagatatctatgacattagtactttcatcagaagaagaacaatttattgaagatatacagattttagcttctgatttctgaaaaatagatttatcctagaatgtttgggaaggacatcatgaaacaggtgtttactcacataatatactaataaacgatcttttctcgacaggtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465545 - DNA, 524 bp, Homo sapiens
ccccgggctgcaggattcggcacgagtatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465546 - DNA, 298 bp, Homo sapiens
tacaccagggacagcatttcgggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagttggaaggagcaaaatgggacttttggctgaaagtgctgagctcctgcggtgggggctgaccgcaagccacgccttctgtgcacctggtcggcccagctagctgccgaccc

SEQ ID NO: 465547 - DNA, 1347 bp, Homo sapiens
aacacgactaacaccctgcagaaacacataagctccttcgaggttgggttttatcttctacagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465548 - DNA, 1457 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtctgcaggtctgttggagtttgctggaagtccactccagaccctgtttgcctgggtatcaccagtggaggctgcagaacggcaaatattgctgcctgatttttcttctggaagcttcatcccagaggggcatccgcctgtatgagggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465549 - DNA, 1536 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtctgcaggtctgttggagtttgctggaagtccactccagaccctgtttgcctgggtatcaccagtggaggctgcagaacggcaaatattgctgcctgatttttcttctggaagcttcatcccagaggggcatccgcctgtatgagggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465550 - DNA, 1575 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtctgcaggtctgttggagtttgctggaagtccactccagaccctgtttgcctgggtatcaccagtggaggctgcagaacggcaaatattgctgcctgatttttcttctggaagcttcatcccagaggggcatccgcctgtatgagggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaaggggtaactttcttggaaattatcccttttttccatgtagacaatactgtgtatctttatgttgtgaatcatccccacatgaagtccactgtggagatatttaaatttgaggaacaacaacgttctctggtatacctgaaaactataaaacatgaacttctcaaaagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465551 - DNA, 1709 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtaagagtaccctgtctggcccacacaatctgacttcttaccttagtcccatacttgacccaggaatgtgccccttgaatgaggaaaacatggctatttgagagcaatgccagtgagattatgcatgcgtttctaaaatacagaagcaaagccccctaaaaacaccaactttaggtgccagaagaagctgtaggggttgtggggatgaatagggaagaaagcgaggaatcattgagacaatgtcttcactactccctctttgttgtaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465552 - DNA, 1086 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttaggctgcccctctgggaagtacatcagacctgtgcagaactggttgaaatagcagcagctggaacaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465553 - DNA, 1584 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtctgcaggtctgttggagtttgctggaagtccactccagaccctgtttgcctgggtatcaccagtggaggctgcagaacggcaaatattgctgcctgatttttcttctggaagcttcatcccagaggggcatccgcctgtatgagggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465554 - DNA, 1386 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465555 - DNA, 1348 bp, Homo sapiens
agtgctgtgtgtatgcggtgtttctgccacggaggaagagactcaggagaaagggtgaatgcctctcgagaagtggagccagtagaacctgaaaactgccaccttattgaggaacttgaaagtggctctgaagatattgatatacttcctagtgggctggcttttatctccagtctgcaggtctgttggagtttgctggaagtccactccagaccctgtttgcctgggtatcaccagtggaggctgcagaacggcaaatattgctgcctgatttttcttctggaagcttcatcccagaggggcatccgcctgtatgagggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465556 - DNA, 1392 bp, Homo sapiens
atccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacct

SEQ ID NO: 465557 - DNA, 1733 bp, Homo sapiens
  misc_feature (2)..(2): n is a, c, g, or t
  misc_feature (6)..(6): n is a, c, g, or t
  misc_feature (9)..(11): n is a, c, g, or t
  misc_feature (13)..(14): n is a, c, g, or t
  misc_feature (19)..(20): n is a, c, g, or t
  misc_feature (1505)..(1505): n is a, c, g, or t
anaganctnnncnncgaannagatgtttaggaatgaggggaaaaagaaagagaagacaaagatggtttcaggtttcccagtctgggcaatttggagagggtgggtaccattaagagatttggagagggtgggtaccattaagagaatgaggcaggacacctttgacactggacgtagtgtcaaatggggcaaaatagatacttgcattcagttcacaggtcctggtatttctccctttgaaatgcagaagatacaacttttggttccttatgaaagcttttcgtctcctatgtggagaggctctggagcacacctgtgtgaatgtgtgtgtgtgtgtggtgggaaaatgttaagtagagtgaaaaatgtatcactgattaaccagtggaaatttattacagcagttaagagccctgggtctggagcaaaactgctgaggtttgaggccccgttttgctgctcactagctacatgatcttgggcaagttatttaagctctctgagcttcagtttcttcctctgcagaatggggatgaaagtggactactacctcatggcatgttttgaggatgaaatgagctaataaacacagtcttcagccctacattaggatggcctaaggaaaacaagaagactgaatgatattccctgaggttctcgactctgtcatccaagctagagtgcagtggggtaaaacacggctcactgcagcctcgatctcttggctcaagctatcctcctgcctcagcctcctgtttatctgggaccacagctgacttatataagttattagtcttctagaaggatcacaaggaaccagcatcaaagaaatggaatccagctaattcccccaagaaactgaagttttcgggacatgacttgtgaaaggcaaacataagctgacatcttttcacactgaacagcaagagccaaagtgtatccgaaaagccattgtcaaaacaaggagtgagaacagctggggtcaagacctaatgaagggcatcactcagcctctttgagcctcggattcctcatttgtaaagtgggcataataatacctcacagggtagttatgagggcaaatgagataatggacacgaaggcacctgtacactccacggtgctatcagaatattgactattagtgctttcatcacgcggctccatccaaacccctgctttccctcactccaacaggcttttactctgtcacccatgctggagtgcagtggtgcaatcttggctcactgaaacctctgcctcctggattcaagcgatcctcccacctcagcctcccgagtagctgggactacaggcaacctggcggttccccgctccagggaggtcaccctcttgatgctgaatttagcacggacacctgatgggcacagtgcactgcagcccagagctcctgagctcaagccatcctcctgcctcagcctccaagtagccaggaccacaggcacgcaccctgaggaggaagaaataccaggtgcgcagctccnagaaaaagccattgaggacgcggcaagaaggccgccatctacaagccaaggagaggggcctcaggcagaaatcgaacctgtcacaccttgcatcttggacttccagcccttcagaactgtgagaaagtaaatttctgtgttcaagctaccaggtctgtgggatttttatggcagccctagcagactaagacaggcatcaatggttccaatgttgcactttattttccg

SEQ ID NO: 465558 - DNA, 1612 bp, Homo sapiens
  misc_feature (2)..(2): n is a, c, g, or t
  misc_feature (6)..(6): n is a, c, g, or t
  misc_feature (9)..(11): n is a, c, g, or t
  misc_feature (13)..(14): n is a, c, g, or t
  misc_feature (19)..(20): n is a, c, g, or t
  misc_feature (1384)..(1384): n is a, c, g, or t
anaganctnnncnncgaannagatgtttaggaatgaggggaaaaagaaagagaagacaaagatggtttcaggtttcccagtctgggcaatttggagagggtgggtaccattaagagatttggagagggtgggtaccattaagagaatgaggcaggacacctttgacactggacgtagtgtcaaatggggcaaaatagatacttgcattcagttcacaggtcctggtatttctccctttgaaatgcagaagatacaacttttggttccttatgaaagcttttcgtctcctatgtggagaggctctggagcacacctgtgtgaatgtgtgtgtgtgtgtggtgggaaaatgttaagtagagtgaaaaatgtatcactgattaaccagtggaaatttattacagcagttaagagccctgggtctggagcaaaactgctgaggtttgaggccccgttttgctgctcactagctacatgatcttgggcaagttatttaagctctctgagcttcagtttcttcctctgcagaatggggatgaaagtggactactacctcatggcatgttttgaggatgaaatgagctaataaacacagtcttcagccctacattaggatggcctaaggaaaacaagaagactgaatgatattccctgctgacttatataagttattagtcttctagaaggatcacaaggaaccagcatcaaagaaatggaatccagctaattcccccaagaaactgaagttttcgggacatgacttgtgaaaggcaaacataagctgacatcttttcacactgaacagcaagagccaaagtgtatccgaaaagccattgtcaaaacaaggagtgagaacagctggggtcaagacctaatgaagggcatcactcagcctctttgagcctcggattcctcatttgtaaagtgggcataataatacctcacagggtagttatgagggcaaatgagataatggacacgaaggcacctgtacactccacggtgctatcagaatattgactattagtgctttcatcacgcggctccatccaaacccctgctttccctcactccaacaggcttttactctgtcacccatgctggagtgcagtggtgcaatcttggctcactgaaacctctgcctcctggattcaagcgatcctcccacctcagcctcccgagtagctgggactacaggcaacctggcggttccccgctccagggaggtcaccctcttgatgctgaatttagcacggacacctgatgggcacagtgcactgcagcccagagctcctgagctcaagccatcctcctgcctcagcctccaagtagccaggaccacaggcacgcaccctgaggaggaagaaataccaggtgcgcagctccnagaaaaagccattgaggacgcggcaagaaggccgccatctacaagccaaggagaggggcctcaggcagaaatcgaacctgtcacaccttgcatcttggacttccagcccttcagaactgtgagaaagtaaatttctgtgttcaagctaccaggtctgtgggatttttatggcagccctagcagactaagacaggcatcaatggttccaatgttgcactttattttccg

SEQ ID NO: 465559 - DNA, 1279 bp, Homo sapiens
  misc_feature (2)..(2): n is a, c, g, or t
  misc_feature (6)..(6): n is a, c, g, or t
  misc_feature (9)..(11): n is a, c, g, or t
  misc_feature (13)..(14): n is a, c, g, or t
  misc_feature (19)..(20): n is a, c, g, or t
  misc_feature (1051)..(1051): n is a, c, g, or t
anaganctnnncnncgaannagatgtttaggaatgaggggaaaaagaaagagaagacaaagatggtttcaggtttcccagtctgggcaatttggagagggtgggtaccattaagagatttggagagggtgggtaccattaagagaatgaggcaggacacctttgacactggacgtagtgtcaaatggggcaaaatagatacttgcattcagttcacaggtcctggtatttctccctttgaaatgcagaagatacaacttttggttccttatgaaagcttttcgtctcctatgtggagaggctctggagcacacctgtgtgaatgtgtgtgtgtgtgtggtgggaaaatgttaagtagagtgaaaaatgtatcactgattaaccagtggaaatttattacagcagttaagagccctgggtctggagcaaaactgctgaggtttgaggccccgttttgctgctcactagctacatgatcttgggcaagttatttaagctctctgagcttcagtttcttcctctgcagaatggggatgaaagtggactactacctcatggcatgttttgaggatgaaatgagctaataaacacagtcttcagccctacattaggatggcctaaggaaaacaagaagactgaatgatattccctgaggttctcgactctgtcatccaagctagagtgcagtggggtaaaacacggctcactgcagcctcgatctcttggctcaagctatcctcctgcctcagcctcctgtttatctgggaccacagaaattattcctttgcaggtggtgcaaaggatcagcacgggagttttgacctgctccgtttccgacctgggtcggttcacccctccttaggcaacctggcggttccccgctccagggaggtcaccctcttgatgctgaatttagcacggacacctgatgggcacagtgcactgcagcccagagctcctgagctcaagccatcctcctgcctcagcctccaagtagccaggaccacaggcacgcaccctgaggaggaagaaataccaggtgcgcagctccnagaaaaagccattgaggacgcggcaagaaggccgccatctacaagccaaggagaggggcctcaggcagaaatcgaacctgtcacaccttgcatcttggacttccagcccttcagaactgtgagaaagtaaatttctgtgttcaagctaccaggtctgtgggatttttatggcagccctagcagactaagacaggcatcaatggttccaatgttgcactttattttccg

SEQ ID NO: 465560 - DNA, 2520 bp, Homo sapiens
  misc_feature (2)..(2): n is a, c, g, or t
  misc_feature (7)..(9): n is a, c, g, or t
  misc_feature (11)..(13): n is a, c, g, or t
tnttttnnnannnaagtatggaaatcatttgcctgatatacataattgatttatttatttattttagaggcagggtctcacttcatctcagcctccagagtagctgaaactacaggtaagtaccaccatgcccagataatttttttttttttggtagagatgacgccttgctgtgttgcccagggtggtctctaattcctggcctttagcaattctcccgccttggcctcctaaagcactggggttacaggcatgaaccactgtgcccagcctgcatgatgtaatctccaaattgagggtcacccaggcatggaatgcacagctctgccagacagaaagcgctttggatgcctgagaaacaacagcttgtccgggctactgatgcgaagagaggccatggtttcctttttctctgctctgaatggcagccttgacgtcacaacagctaggaaccactggagggacaaataacaaggcgcaagccagaagcgccctgctctgtcgcaggggcagggccattttcatccagttctgatgtcttctgtggccgctgcgagtcggcgggagtagagacaaatgactggagctttaggcgtaaaggcggtctctctctaggctgatcaaacagccctttgcccagtgctaattgccttcacggaacctggataaactacagttcccgaattaaacttgtttctgatgaactagacttcccagggaatgggtgtagtgattttgctgatggttcagacatcggcactttccctgaagggctcaacttcctgtgaaacacagcacattcacaaacatctgaagccaactgcaaggcacccgtcactcagcgagaaaagcagaaaggtgccaattcagatggctgagctacttcgcctgggtcccgacctgtatcaccacagggtcacagaaatggaaccttctccgtcacacctcctgatggcagtcagctgtgacccgctgaatccaggacatcatgcattccagtttcatttgcgagaacatttccaggtccggctgaagcctagtggctccagcagaggtctcaacccctttgggatgctcagtgggagacagaatcaagggccaatgatccatgacctagtcctagtgcccatgtcagtttgtcaaaggccctcagagcagattgtgttttccctggcgggggcttgacttctttgctttaaaaaggattcttaagtatttattgcagtaaaattaaccaccttcaaatttctgccagatcccctggaggtatatagcttattaacacaaaacaaatgtgacacttgaaaggcaggagacttggtttctattctctggcccactactgacttattgggtggcttcaggcaaataagtgaaatcaagaagacaccatcttcaacaagcacagagtgggcacctggcagaggtggaaacgaaggcaagcaaatgcagtcattttgttggaggactattctacatttccaaagcaatgaagacatgaccccaaactaaactctcctgcaacgtattcttacaagaaaaaggctaaaagccttattgcttaacaaaagctaaacaatgtgaattatttcaataactggtccaaaaagctgcagcaggccactgagtaacttggacatctgttgccatgcttgttcatgctttcccctgagatgacatatatgtatcatcattaataggtgtccttgattttgataagaacaatattcctgtacatccccacatctcctgtacatagccatgtgctgccatcttctgattatgcccagtggagtgtaaacattttttcatgaaaaagcaaaatcaataaaagtaaaactccccacttttcctgccagtagtgcccttggtaacaaacagggcagagacaccaatacagagattacaatactctcagacataattcaagcagaactttaaatggatcagtgcatgttataaactttcttttttttgcaagtgccaagcgtgcttatgctactattcattctgagatagacagatcatcaatgaccttctgggtcactgactagggagaaagctgactataaaaaagagtgggagaaaaataaagtgggggttgcttccttccaccctagaccccctactgccttgaatgaaagaagacagatggcagccacctttccctttaattaggaggggcagcttagaagggacagtcctgctcacttggcactatctttaacaagactgtttagatggcaatgctctgctcattcgcccttctttcaaactgttcttaatttttcacttacaaactgaatttccgtaaatttaatggtgaaacaattacagctctgactacaacgctatacataaatgacacacttaaagatgtttgctgaattaaaaattcacagatattcctataaagaggctggaatgtttcaaatgaaatacagctacctccagtcctatcagcaccactttgagataaaatatgaattcccaggacacagaagctctaacttaaattca

SEQ ID NO: 465561 - DNA, 3773 bp, Homo sapiens
  misc_feature (1)..(3): n is a, c, g, or t
  misc_feature (9)..(11): n is a, c, g, or t
  misc_feature (13)..(13): n is a, c, g, or t
nnnatactnnnanagtcagcaccactatgctaccaaatttcacagaaagctcaagatatacaaatgagtttctgattcccaaagtgattgtgaaaagtgatcccattgaaactactcctggtaaagatgttttgaacattgttgaaatgacaacaaaagatctggaatattacgtaaagttagttgataaagcagcaacaggacttgagaggattaactccaatcttaaaagaagttctactctgggaaaaaatgctatcaaaaaacattgcatgctacagagaaatctttcctggaagaaagagtcaatcaatgccgcaaactttattattgtctcattttatgaaattgccacagtcaccccagcctttagcaaccaccatcctgatcagtcagcagctttcaacactgagataagaacctccatcagcaaaaagattatgccttgttgaaacctcaggtgattgcagcagttttaacaataaagtatttttaaattaaggtatatacatttttagacataatgccattgaacatttaatacactccattatagtgtaaatataactgttatatgcactgggaaaccaaaaaattcgtgtgactcaccttattgcaatatttgctctattgcagtgttctggaaccaaacttacaatatgtctgagctatgcctgtacacatattctaattttgtggtaaatgtataaaattctaggagaaaaaatagctttggaagacttttagcaagttagttttatttcatctttatcacatcagagggctagggatcataaaaatggttgcaactttcttattacttatatagaaaacctttagcggaaagattcaaaatgtctatacggataattatatatttttaatacatgattttacttacctctgtgacatttattaaagcttaatgttaatatgttttataaatccattgtaacttcttgtggcagtctacatttagtcctcaccccttacagtcactgaaaaatttagccaaaaataactaatgctacataagcatatggctctatggcataataaaaggaaaatctatgtcatccatggatttcccactaggttttgaagctctggctttcaagaaaatcttcttaacactgtattaaacacaaccattagtattatctttggaaaatcaagcattatttagaccatcaatcaaattcataggaaaatctcacaaacattatccctaaaataaaaaagcatttaagcacctaatcatgcatgaagccctcagtgctaagaaaattaattgtatagctctaggtcattgacctgtagtagttttacaacctgaaacagatcatgtccctgtccctgtaggtcttgtggttaacagagaagtaatagtagtcttcaaggagtttagacctttacatgatttcatggggaaaaattagaataagtatctgcagtaatgaggagaactacagttggaaagggggagaaagaaaactgaatgccaattgctacttaattctgtcaacataaagaattattagagatttttaaacccttctatttccctcacttcccttccttcattaaaagcagtatatttggacatggctagtaaaagtgaagaggcataaaaataccgaacaggatcacttggagggagaatatttgtaacaagaacatcaaggcattggtggtttgggccacatgcaactacatggaaatctctttattttctgaaatgcttatttatgaggaaaggtttatgtatgattgactggttctgtgatatccaagtctgtacctcaaattccctatttaggctttattatttcacatatttaagattcagtactaagttatatagtcaataatgggtatttgccaaatatatgtattctaagttccacctgaaacttcttggatattcttaaccgaaacattttgtgctgacctttagattctgcagctttaaaatggtgacaaaaatatctttcctgacagatttacaaggtgattttgagaaacagataaaataatgaattcataggtgttatgtaaataagttttataaaatgttataaagtttaaagtgttatgaagaacactatactgacccctcacaaagaggcatgaattctttccccctcccctccccttgagatggagtctcgctctgtcgccaggctggaaagcagaattattcaaataatttatttcattttgcttttaatcctttgtatctatatttcccagaaacattctagggtgttttaaataagtaaatattcacagttcacagaatccaaaaatgcattcaaatatctaccactcaaaaaaaaaaaaaaaaaacggcccacctaaagcctttcttcctgtttactaaaacgagtctctcataataactattttccgttttcccttttcactaaaacttagttgacaggaaaacagatgatactgactcaaatgataacctaaaactcacttctagtaattcaatttattcaagatttcacttatttattcccatgtgcaagataccactatcaaaataatctgtttgaaactgaaagtaacaagttgttagttttcatttgtctttctaatgaattgttcgttagcccatagtacaggcatataacagttttttccacaaagtattttaacctagtactggagatgaatggatagatagaaactgctatttcccctttttcatctggttatacattttcattgtgccatcattgtgaataattgggctcacatgatactaatagcatagagatttggaatttttgcatttataaagatctaaaatagtcatgattaaatatttggaagaaactaaaactaattttgaataactgttattgtgatgggggatgggattcaatcttaacacatttaggaaatgcaaaataaattatctaatctccttaattatgtagagtattttaatatatgcaaaattaaactttaaatgatcgttcagtaagatcaaatattcgttatgaaatcactatttaatcattgctcatagttgcctaacccattacagttcaaactgctgttaaaagaatggcctaaacttgcagtttcacctattacattgtttgaggagccacagatcatagcgtgtgtggtccaaaaaaagtcagaaagaataaaattgatattagcattttttgtttacttctcttaatattgctgaaaaaagcaaagacactcttcatcctccttgatgtgatgctgattttccattcaagtggaatcccacagcaggacattggaattaagcaataaagtgctcttggtgaccaaacaccagacatgtcacaattaacatgagtaaattaggttacatcttatttgtcaactcattttcattactagttttctctaaccaccaaatggatgggttagaaagtgatggattatatgcctgttcaccaagctgctataagtgtcttagaggctttgtcaagaaagtcacccacgactgggcaagctaaagggacttgccaaaggagtcaagaggaggtaggcagagcatgaaagcccttcttaggagaatgaaaaaagaaatgggaacagaagctaaaaggatcctttctttatcctggacctttgggatttgattgttaaatgtcttgaggtaatcttctttatgttaaatctgattggtgttctataaccttcctgtacttgaatattgattcctcaccctaggtttggaaagttctctgttatctctttgaatctctttctaa

SEQ ID NO: 465562 - DNA, 1969 bp, Homo sapiens
tcgatgggaacgtctccgttcggccaggagccgaccaggatgaggaaaccacaggcgtagtccgagggtagcagcacagcatctcagcctcaggcctgcccggatgatgttggggatcaagatgaacacactgcagccaaggacaagagccccagaggagctctttgtcctgcaggagagggccggacacacgtcagagaagatggttgtatcttttcacggctcttctctgagaaatgaagccacaccatgttacagtctggaagaggaagccgggaatgggagatggcaacaatccctgtcattggaacgctggcctctctggacaagccacccttttggaaccccttcccttatgcctgtggcggtggcatggtgctgtatcctgcctgggctctgggctctggcctctgctctgtcctccctcttgctctccctaccctgtttctcaggggcctggatgcctctcgctctggtcaaatgtcttcaacaaagatgacttcccagtctgtcagggagacacttcctggagatccgtgtcactcgttccccccttccaccggcacatacctggacaacaccgtgtgtttcgccgtcgccccgtatgcctcctgtgaaacacattcacaccatctgctgtgggatacgccagtgccacgcgtggtcacatggtctccacctcggattcgcccctgttcctgtttgcacgtgtcccataaagcgtggtctgctttccggagccccagggcttttagaagcggggcaggccactgctctttcaaaggacgagggaggcagagggctgatggatcagtgcacttgcagctgacactaggccttgattcctatgggatcattctgtgctgcagggaggccctgcctgcctcaccagatgtggtgagtccatcctatctcactcggagggcgccaaaatcagatctgaagtggagtcctgagaacagatgcaggcgtcctgatgttccccatccctcggtggaagggacgcagcctgactgccaggagtggagcgggagtcggcccagccaatgcgcatgcgcgaggagccagcggcttctcccatcacagtggttcccaccgttgtcttagaaaccagtccccgaggcttggcaaagcaggagccctccatggaggtgcttgggtgtcggggcaaaccccaggcggagtccgggggaagcagcacggcatcccagcctcaggcctgcccggacggtgttggttgggctacattgaggccaggtgcagtggctcacacctctaatcccagttctttgggaggctgaggccagcggatcacgaagtcaggagatcaagaccatcctggacaacacggtgaaaccctgtctcttcaaatatacaaagaattaaccagagaagcagggaatctggaattttgggtgaaatgtctgtttccagaagctgaaaatgctctcaaatggaaaattcagtagggtcagaatggcctggggtactgcacacttcctgccaggaatagaaggccccacagctataggacctctcttccgtttagttctttggaaggatgagcaaattattcagcctctctgagcctcagttttctcatccataaaatgaggacagtacaccaacctcgcaggtcacaaggatgttatgaaatcagagtgcagtgaatagaagacacttctctgcaccccaaaagctccatgctgattgcgagaaggaaatgctggatggaggggttcctggaactactgtgagggaaatggtaacagaactttggatgtggaacgtgcagtaggagttacacgaagtgcgggtctgcacttggggtggtcagcacggcggatgcccagcaaacgcactgcctggtccacatcccggagtggtctctacgccccagtcggcatcgcagctgatggtgaaacttttggtgtggcagaagagtgtccacaaactttggaaggtatcc

SEQ ID NO: 465563 - DNA, 1724 bp, Homo sapiens
tcgatgggaacgtctccgttcggccaggagccgaccaggatgaggaaaccacaggcgtagtccgagggtagcagcacagcatctcagcctcaggcctgcccggatgatgttggggatcaagatgaacacactgcagccaaggacaagagccccagaggagctctttgtcctgcaggagagggccggacacacgtcagagaagatggttgtatcttttcacggctcttctctgagaaatgaagccacaccatgttacagtctggaagaggaagccgggaatgggagatggcaacaatccctgtcattggaacgctggcctctctggacaagccacccttttggaaccccttcccttatgcctgtggcggtggcatggtgctgtatcctgcctgggctctgggctctggcctctgctctgtcctccctcttgctctccctaccctgtttctcaggggcctggatgcctctcgctctggtcaaatgtcttcaacaaagatgacttcccagtctgtcagggagacacttcctggagatccgtgtcactcgttccccccttccaccggcacatacctggacaacaccgtgtgtttcgccgtcgccccgtatgcctcctgtgaaacacattcacaccatctgctgtgggatacgccagtgccacgcgtggtcacatggtctccacctcggattcgcccctgttcctgtttgcacgtgtcccataaagcgtggtctgctttccggagccccagggcttttagaagcggggcaggccactgctctttcaaaggacgagggaggcagagggctgatggatcagtgcacttgcagctgacactaggccttgattcctatgggatcattctgtgctgcagggaggccctgcctgcctcaccagatgtggtgagtccatcctatctcactcggagggcgccaaaatcagatctgaagtggagtcctgagaacagatgcaggcgtcctgatgttccccatccctcggtggaagggacgcagcctgactgccaggagtggagcgggagtcggcccagccaatgcgcatgcgcgaggagccagcggcttctcccatcacagtggttcccaccgttgtcttagaaaccagtccccgaggcttggcaaagcaggagccctccatggaggtgcttgggtgtcggggcaaaccccaggcggagtccgggggaagcagcacggcatcccagcctcaggcctgcccggacggtgttggttgggctacattgaggccaggtgcagtggctcacacctctaatcccagttctttgggaggctgaggccagcggatcacgaagtcaggagatcaagaccatcctggacaacacggtgaaaccctgtctcttcaaatatacaaagaattaaccagagaagcagggaatctggaattttgggtgaaatgtctgtttccagaagctgaaaatgctctcaaatggaaaattcagtagggtcagaatggcctggggtactgcacacttcctgccaggaatagaaggccccacagctataggacctctcttccgtttagttctttggaaggatgagcaaattattcagcctctctgagcctcagttttctcatccataaaatgaggacagtacaccaacctcgcaggtcacaaggatgttatgaaatcagagaagctccctggctccaggcagtgcttggtcccctcactgcagcaggaagcccagcttgtgaa

SEQ ID NO: 465564 - DNA, 4169 bp, Homo sapiens
  misc_feature (1)..(3): n is a, c, g, or t
  misc_feature (9)..(11): n is a, c, g, or t
nnntccttnnnaggtttgttactcagaaccgccaaatcccgcgctcctgagactggggccctgtgttccacccactcctctccctttgatagatattgccagccgatttttccaagtagttgcaccattttccactcccaccagcagcgtatgagaattctgtttgccccacatgggctctgacacttgggattgtccgtctgagaatgacagcacagcagtatggctgagtcccgcagacatgcgcccgatggagaatccaaggtgcccaaggaggcccctggcggagaagaaagccaggtctctggacaggccgcaggcccccgggaaaggctcggagtcgtgggactgccattggctctccctgcccactgccccctccaggaaggcgcttcactggacgaccagtgattgggccagacattcagacagcccagctccatctgcagaggctcactgcaccaccgctgcagcccccactcccgaggagaccggagattttctccccagcgagcagaggccttcgcaagacaccaagaaggggtggctgaagaccatgctgaacttcttcgtgaggacgggccctgaggagcccagagaaaaggccagcaggaggccaagggggaaggagggtatctcccagcatccggagcccctggaagcagcaggggagccagccctcaggaagaaagcccaccacgacaagaagcccagccgcaagaagcaaggtcacaagaaacacgcggccgaggtgactaaggcagctcaagaccaggaggccagaggccgagaggaagggttgtccaaggcagctgctgccttgcgctccggggaggctgacctgggcccagctcgcaggggtggggaagattctgatcaccagtccttcctcatcaaagtggatggtactggagctttggatgtttctccccatgccacaggtcatcagcaagaagaggagctcaaaaagcctgaccaggatgctatcattcagatgatagtggaattgctcaaaagagtgggagaccagtgggaagaagagcaatctctggcctcacagctgggggtggccctgccaaacccagcaccagctgttaggaagaaatcccaagagaaaaagacaagcctcaagagaacctcaaagacaaaccccaagaaacacggctccgaggaggccaagaggggggctgcagatgtttccagtccagaggcctggccacccaagaagtccagctttctgcccctgtgtgtcagcggccatcggccttccatctccagcagctatgaagaattcattcagaagatcatttccatgctccaagatgcagaagaacagcaaggagaggagcaacctcaagtccagcaggaagaggtgggtgtagaaaacccggccccacactgcagaaggaaatctcaagaaaaaaggtcgagcttcaggagagcgttttaccataagaaacacacctccaaggaacccagaagagcgggggcagcaggggctgccagcccagaggcccgacgacccaagaggcccagctttctgcccctgtgtgttggtggccatcggccctccacctccagcagccttgatccagaagatctcgagtgccgggagcccctgcccgcagaaggggagccagttgtgatctcagaagcaccctcccaggctagaggccacacgccagaaggggcacctcagctgagtggagcatgtgaatctaaggagatcatcatccagaagcttgtggcacttctccaagaagtggatggccaactggggcagcagatcaggcgccaccccagctttaagaggtttttttacgagttctcggactcctccctcagcaagctggtagccaccctgcgcagccaggtggctcactcctctaagctggacaggaaccgcgccaggagactctaccagtttgacgttagcttagctaacaaatttgctggcagcaacagccatgccatgtgcatcctcatgggcctaagagaccactacaattgcacccagttcccatacagggaggaccagccgaacatcacaagtcctaaggttgaaagtccagattgaaagctgtgtcttgcactcaaattcccttgaactagccaaatggttcgcagctttagccaggagaccctgaagatgctctgtgatgtcccaatccctgcttcacaaacgtgatggaagacaagagcagacaatcattctgtgtccataccctagtatctgagaagcacagagcattcttccacaaggcaagacacagaggccatgtctggggaaatcagcactggactgggaatgaggaagactggggctctacctgctgaacctaccccagacttgctgcatgaccctctacacattccccctcctctccagactttggagtctaggatcccacccagaaggcctactgatattttctcagatgttcatgttaactgagtctagtttttaaactaaatttttatttaatctctaaacagaacatccacatgcatccaaacagatatgcatcgaagtgtatcccatcatttcttcagttgaccagtagttcttcatgctcatatggatttgtagatgcctcccaggaactctgcaggcccaagatggaaaaacctagagactggggacacttggtctctcagaatccttctaaccctgtgtcctgtcattctatgactagagaaatggagctgataccttgcacctctcccatctcatgggattggctaggagtcagtgagaaaatggatgtgaagagttctgaaaattacctagtgccatgtccatgtaggcactatagcttcttttgggtagttttcaggaagtggaggagggcttcaatgggctggactgccatggattgttgcacaggggtgcactgctcaagagcaccatactccaggaggtactattcatgtcctagacattgtggatttgtagatttatcatgacagttttgcagctggtagcagtaacatgtcttgagaaaagggctattttttgtatttgcacaaaggtgaagtgtgggggtgccagaggctctgccttctgtatagctcaacagtttcaatagcttgactcaggtgtgaaatttgccacatgttcatatctatgtgcaggaaggacaagactgtagacagacagtcggctcccttggacactgcccagaacatgtggtcatgggggaaagggtgttaaacctggatggcaagtgagatcttgtgacccttggggacatggtattgccgtgttgaacctgctgtcgcaccatggggtaggactggggaggaggagcagtctagagcggagaggccctgggtgcttatatgggactggcctccaacctgaggcactggcttcataagctcaactcagcctatccggaaagccatttagtttttattgctgcttctgagaagtgggggagaggtgagctatttgtggatttgttttaggcagtgttcacaatcatagcacctaaatatgaaggatcagaataagttatgaaatgaaggtcaggaaccttttgtacatagtttcttatttggaatgatgttctttaagccctatgagtatttggtatgtgctcctgatgctggcatctgagtctcatttttgtaccgtgttatttgagcaaataaatacattaacttgcacaaacctgtgatctgggttattcaccatggaagcaagacagatacccacctgccacatctatgactgtctggtgcctgcaaggctgtgtgggttggcctccttgtccctgcctggatcccctccaggtgtcccatccttggagcgccagctctctgatgcagtaaaaaagtgtcctgggctgggtgtcagaagacttgggttttaatccagctgcccccaggctgggtgaccctggggacaagatacttgccctccagacctgacattctacaactcagtgactctcaatgtgacagttcattgcatgtccaggaaaatcgggagcagtactgattccaccttgtctcttattagtcccccaaatctggtgcttaaattctgtcactcagagccaagataaaaaattgttagacaaggagaacacatggacacaggaaggggaacatcacactctggggactgttgtggggtggggggaggggggagggatagcatt

SEQ ID NO: 465565 - DNA, 1088 bp, Homo sapiens
ggagtcggctgtgttggcttttacgcccataatgtttgtgtgggctcgcctgtctgcacctgtcattgtttatgtacgcgttctacctataggaatgtgcggggaactttctagacgcatgaagagtgatgctgtggaatctgatacagcctacagttctaggattcacccttggttcttttgcagagtcaagaatagtcttggtgctagagggaccaagccagcaaagatttgcactgccagccaagggacttatttccctgcctccaacagttttgccgtcactaaagctgctacacatgctgagcttaaatgcctgcttatagcaaaagcagccatttttggtggggacaaacaaaccacatccaaaccactgcaaatcccatacataccagggctccactccagacccactgaattgaatcctttggggatggtgcctgaaaaaaatatattttaaacacccaagggggaggctctttggccgtggtcagcagaggcagctgtgccactgcctgtgggtgccacgcctgcctcacagcagcaacttcctcataagaaagtctctgctgttatttagatgtgtgtcttgtctcccagactcagatacaagcccatcaaggcagtgaggttgacatctttttttctgacttgtctgcaaacccgtcatgaggattgttgcacagtcatgtttgggtaatgccacgtacagtctttccttcttaggcaattatattagcagttaaaggctctgagaagttttgcaatgaagatgctgtcataagtttgtctaattcagcatttgacaacagaactgattttcctagcaacattttggtccagagagaaggtgatgcaagatgcagaaatgactgagagtatggtgagcacttgttcactacgccagaaataaaagatcattgaagtgagattgattaaaactacaatcaataaaagatcattgaagtgaaattgattaaaactacaatcattgtcaaataaccacatttaactcctctcttaaaacttgtcacttaagacactctgttaactaaatctctttaaagtattaaatcatgtcattgttc

SEQ ID NO: 465566 - DNA, 2157 bp, Homo sapiens
gagttaatgggtgcagcacaccagcatgtcacacgtatacatatctgttgcagtttctcggtgcaaacagaaccctgagaaatggtctgggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatggaatttaatctgtttattgattttgttttttgtttttcatagtattttgagttatataaagagaaaacatttctatataagtaagtattctttgttaggaagttggtgctaaattgaaatgcaattttgttactgaaattaatattttggggtaaagaaaacattttaaaatgtgttttcacattaaattttttaaattttttcaagtatattagagttaaaatctaacaaacagccaaataaaaactagacaactttcaagttatttattttagatagaatgtagttataggaagctaatcagtatgtggaggggaggaaacattataaagtgctctttcttgaaaacttctttaagtaggataaaaaaatttatattttagtataggcatttgaatctttgcagtttatcgtctgctttcaccttccatccttctcataatcccaataaaacaacacttgaaactatttataaataaacaaaaaa

SEQ ID NO: 465567 - DNA, 942 bp, Homo sapiens
gatgtgaagggagtggccagagaacagcagcacactgggggttgggccagtcagcagccatggtcaccatgtgtgaaggagtgcatgagagtggtgcatggctgtggtgtgcacgtgtgtgcgtgtgatgcatgtgcatttgcacgcatgtgctgtggtgtgtgtgatgtacgtgcatttgcacgcgtgtgctgtggcgtgtgtgatgtacgtgcatttgcacgcgtgtgctgtggcgtgtgatcccatcctaatgaggagcaagggatcagagggagatggtgctcagattgatgagtgtggtggaaatcagcacgagggctatgttatctcagtgaaatatgagttccacagcacgaaaggaaacgacagccaacaggatttggccagtggcagtccctgcctttggattaaagagccctttgaggcttgcttggtgatgtcatggaaaacagcatatgacaccaagatatccccatatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaacgagacttgctgggtttatccccgtatccaatgagacttgctgggtttatccccgtatccaatgagacttgctgggtttatccccgtatccaatgagacttgctgggtttatcccc

SEQ ID NO: 465568 - DNA, 3661 bp, Homo sapiens
aggggtttggtgtagattattttgttaatgagctgttgggtacacctcccagacggggcagccggtcagaggcgcccccccacctcccagacggggcagcggccgggtgggggctgccccccacctcctggacggggcagctggccgggctggggctgccccccacctcccggacggggcggctgccaggcggaggagctcctcacttcccagactgggtggccggtcagagacgctcctcacttcccagacgggttggcggcagggcagagacactcctcagttcccagacggggtcgcggccgggcagaggcgctcttcacatctcagacggggcggcggggcagaggcgctccccacatcccagacgatgggcggccgggcagagacgctcctcacttcctagacgggatgacggccgggaagaggcgctcctcacttcccagactgggcggccgggcagaggggctcctcacatcccagaggatgggcggccaggcagagacgctcctcacttcctagacggggtggcggccgggcagaggctgcaatctcggcactttgggaggccaaggcaggcggctgggaggaggcctgcaggctctcctcctgcagctcaggcttcactctctgatgtggcgctggagtgctgctgtggcaattggggttcatggaccactgacatttagggatgtggccatagaattctctctggaggagtggcaatgcctggacactgcacaacggaatttatataggaaagtgatgtttgagaactacagaaacctggtcttcctggtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaaccttactaaacataagaaaattcatactggagagaaaccctacaaatgtgaagaatgtggcaaagcttttaaccagtttgcaaaccttactagacataagaaaattcatactggagagaaatcctacaaatgtgaagaatgcggcaaagcttttatacagtcctcaaaccttactgaacatatgagaattcatactggagagaaaccctacaaatgtgaagaatgtggcaaagcttttaatgggtgctccagccttactcgacataagagaattcacactagagagaatacctacaaatgtgaagaatgtggcaaaggctttactttattttcaacccttactaaccataaagtaattcatactggagagaaatcctacaaatgtgatgaatgtggcaatgtttttaactggcctgcaactcttgctaatcataagagaattcatgctagagagaaaccctacaaatgtgaagaatgtggcaaagcttttaaccggtcctcacaccttactagacataagaaaattcatactggtgagaaactctacaaacctgaaaaatgtgacaataattttgataacacctaaaacttttctaaacataaaagacaccatcctgttgagaaaccctaaaaatgtgaagaatttgacaaagccttccaatgattgttacacttgcttgtaggtaagataatttatattggagaaaactttataagtgtaaagaatgtgacaaaacttaaccaatactcacatcttattgcacaggaaagcatttttacttgagaaagattgtacaagtataaagaatgtgaaaaagtcattgatatcttttcacatcttactcaacaccagagtttatacttattaaaagcattataaatgcaattactgtcaaaagaaatttcagaaaacataacactttaaagtgaagaagcatgtttattttgaagacaaacataacaaatataaggagcataggagggttgtagtacctttacttgtattacaaatcttattgtacgcattttgtactagagaaaaacactgaagcagttgctcaaactttgttcaacatcagggaatttatattggagaaaaatcctgcaaatgtaatgaatttggaaaaacattttttttcaaaaactacggcgtagaaaacatgaatttatattgaaatgtgtttttgcagatgcagtaagtatgaaaaatatttaatccaaaattgagtctatgtaaatattaaataatttacagtagaaataactaaggcactgacactttagacattacactaaaacagagtgttgagtataaaaaaatctataagttgttagattatttgtaaataactttaaaaggagtagaagattctttggagagttataattacattgaaagtatactttttttcttgaaaaaattatggcttatttgaaaagtaaataatgatgaaattcaactctcaaattactttatttcattcctattgtattcacatgtgaaagcatgtgataaattgttgctgtgtcagatataggagagattcttttttattagatgggcattatttatggttttttctgtggaagagtatgggcattaaaatgtaaggtttatgatgaaaatctaagtggagaggccctgttagtttacttttcatattgagtgatgcatgaggtaggtgtttggagtaatattctgcatcatagagaaaagcatttttaattttactttaaattaaatgtaattaaattactagtgaatcattttactaattgtacttttatgctataaatgcagtacatttgaaaatttttagattatgtataagcttaattttataattaaacatttctttaacatgttaagactattgtgcattcaatgaagcgttattatgccattaactttaacctttttcactttactcaaggagggaggggggggtgctagtttaagggtttttggaagaggtgcacatttatgtgtgtgtgtatgtgtgtgtgttgcactgatgcaaacaactatattgttggatccctgattttccgcgtttttcagctgggggtcggaggtttatttgctgttaaaaagactcttttgcttctgcatcggcagagagtcttctccagcatgggccccataagtagatttgaccaactttgaaccctct

SEQ ID NO: 465569 - DNA, 1566 bp, Homo sapiens
aaccagtgttctttaaaactatcaagtttatcaaaaacaaggacaatctgagagactgtaacagccaagaggagcctaaggcgacatgatgacaaaatgtactgggatattcagggatggggatcctagaacagaaaaagaacatacagaagagtatacaatgcacaatctcatttatataaattaccagaaaatcaaaacaagttatgctgttagaaatcgggatagtggtgacccttggtatagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatccatacttgcgtgtgtcatggatccaccctactggatttcacataactttctcattagggcacattaatatgagtcatgggaattaggctctagctctcttctttgtcttaagttaaatgctttcacaatgtataaaaagcaaaaatggtgtgtttgtgggatgagtgtgtaaaaattttaaacaccttatttaaaatggattagtattctctggttacctaaaatgatgcccaatcagatataacaacaccgttttaaatattaatactaagtataatattctaagcatggtacagtaaatgtaacatacataatatctacacaaacacttttgaaatgtgaagatctgcacattcttatttgccaagattgactgcggtatcaaaatgtgtcaattttgataattcgtgattatcacaaatatcacagttaatgctgctaaaataatcccgagaagcaatatagcaatgtggttaagatgatgaactcttggtcactacaagttgactctaccactaatagttttagtccttggcaagttatttaaattctcagtgcatcaatttcctaacctttaacaagagggaaatggtaataacctattaataaattattgtgagtattaaacaggcaaaatcatgtgaagtacttagaattattgttagtgtaataaattttattatgttattgacattaacattattttatcaaactttttagaaaagttcaaactatggagactaatattataattatttatttagactgtccatggttatatacatgtatattgctttagtgagtttgtatgtgaaaatgaaatataaacatgtagagatatacacatatcaaaacttactgtcatcattattttgtccagcgaccttctcaagaaaagaaaatttccttgacttattaaagcaccttctcagaaaatgtattatgaagagaggtcaaagttctattttaaacttgccacaaagtgagaaactcctgggggcaggggagaaaagccaaacaaggcaggacatgacggctggttcctgtaatcccagctacttggaaggctgaggcaggaggactgcttgagctgaggagtttaacactagcttgggcaacacagtgagacctactctctaaataagtaaataaataaata

SEQ ID NO: 465570 - DNA, 1687 bp, Homo sapiens
ggatgatggtttccagcttcatctgtgtccctgcaaaggacatgaattcattctttttatggctgcacagtattccatggtgtatatgtgccgcacttcctttattcagtctatcattgatgggcatttggctttgggtgaaactttagttggggcttttgcctggaacacctacatgaggcctcctcatgtggtctgggcttccccacaacatggcgactggtttttaaagatgagcatggagagtcaggtggaagccatattgtcttttatgaccttgtctccaagctgtgtagtgtcactagccctgaattttgttcatcaagacagccacaaacgcccatccaatttcaaagtgaggaaaaaatttactctatctctggctggggattggcaaaattctgaaagactactggggaccagatatattgctgtggcaaattttggaaaaaaaaatacatcatgctgtaatgttgtactttaataaaatatttaaaattaaaagaagagaatgcaggttcccacagatactgcaagccccctcaagcttaggcagtggccctaacttagatctctcttccttctagatcaacacagctgcaatggagggttcataacggcacctgcctggttggagagaggtttaagcagatgacaaggaggaagtgcctggtgcaggataaggcctcaggaatggcccaggttgtccctgcttggagcttcagatgtggtttgaacccaggtctgcatgattctcaagtcatacttcaacaaacacaataaaactcatatcaaatgttggacagcattacttggcattattgggttgcaaaacttcaagccagttacaggattaggtttgattctagcctggaaataggcttatcacctaagtcgaggatggttatagacaagacctatgtttaaaatgaactgaagaggaaaagtaacaaaaacagactaagacccagagtcccagggaatctgaggccataattagcaaggactgatacagggtaaatactaagaaattagacatatatgttggaagtttaggtgaggaacagagtctcttggtatcctttttcctctctcctccactcacttgtagttccagtaatctgtgccttaaatctaaatgacattcataagtagaacaagtgatgccaccattatgatcaataggcatgtaccaagatcaagcttccagatcaaaaaagtataaggcctttgagactgatccttcagtagagagatttcatgtggtagagaaagtgatagttgtcttcatactcttaggcaacccctcaccatcccctacatcttcctaatttccttgcagttagacagattggcgtaagagtggttttggcaaatgggctatgagtgggagtcatgtcatcacttccaggctaatgtgtttaagagatggcacagaactgtccaagagcctcttcccttgccacatatgagaggacttcaaaatctggaaaaatggaaattaaattaaatggaattaaaagtgtaaaaatataaacttcatttctttacataagctccatcaagttcaagacacttttttttatttttccctccatattttcaaaagaagggactttagaaagcaaatataagtctctccaattttatgtttaaagtgtcatttcccaactgaactggcatttgg

SEQ ID NO: 465571 - DNA, 6821 bp, Homo sapiens
agcagtatgattcctaaaggtggcccctcctgactgcggcagagcaccctcagcctggcttctgccaccacgagaaacgtgcatgccagcagggcctctccagcctgcacgtgcctggtctctcggagtcattcagcacagcgacccttccccagtaccgaccgattttctgttttcttgtcacctcccgttcctggttttcccatgtctccctggcttctcctcttcacattccagttccactctgtctgggtggtcttataattgatttatttaccttctggaaacctttctttactcatgtcataaatgagagaaaatggactgaacagccccctctgtttccagtatcctacggttctgtgggaaaaactgtaaatatgccctccccacccccacacatacacagcttaggtaaaaacagtgcccaagtttaggaatatttgcagatattgtcctgatggtaattctgtcaatttctcgtttccagctagctgtttaacttctgacggtgattcatggatatttatgatgagctctctccggaacagcacaacctttctttatactccatggagctcgtgctgaagaaaagcactgggcacagcgctgcacaagtggccttaacagaaactgctcccggctcccagcacagcagtcctctccatgtcacagccccgccgtctgccactacttttgatacagccttttttaaccaaggaaaacagaccaaaagtacagcagatcccagcatctttgtggcaacttacgtgtcagtgacgagtaaagaggtggccgtcaatgacgatgagatggataactttctgccagatactcactggaccactccacggatggtttctccaatacagtatatcacagtcagcccaccagggctgcccagggaagcattagaacctatgctcactccatcattacccatggtttctttacaagatgaagaagtgacatcgggctggcagaacacaacgcgacaaccagcggcatatgctgagtccgccagtcatttccacacctttcggtcagcttttcgcacctctgagggcatcctcccggtctttaatgccacagccgttaggcgacggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatccttgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttatgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatccggtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccgtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctac

SEQ ID NO: 465572 - DNA, 276 bp, Homo sapiens
ttgtggcttccctaacagagggtgtggaaaccaccctttttttaagctcccggtctttaatgccacagccgttaggcgacggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccat

SEQ ID NO: 465573 - DNA, 5736 bp, Homo sapiens
  misc_feature (40)..(40): n is a, c, g, or t
  misc_feature (43)..(43): n is a, c, g, or t
  misc_feature (117)..(117): n is a, c, g, or t
tgtgtcaggagacagagatgagaattccttctctctcaanagntctatctcttcttcagcacggcggaccaccaggtcagagccaattcgcagagcagggaagagtggtacctcaanacccactacccctgggtctactgccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatccttgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttatgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatccggtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccgtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctac

SEQ ID NO: 465574 - DNA, 1863 bp, Homo sapiens
atacaccatctggggaccccctcaaagtattcacttcaactcccacaacccccgaggaatgactagtgggtttctttcccctcccctcgggtggccttgtgaggaagccaggaagtactgtgagcggcagggcctgggagagcccctgtggccgacaggaggagatcagccttcatcgcactctcagaaacggaagtgtgggcgtgtgttatgttgctgcagcaaccaaaggcaaccgagcagcaaacctcagatgactgagcccagcccattcaacgagggggagtttcaggtggcctgtgttccccagggactgggcctagctcaatcgggaaaagtcagcatccaaaagtcctcaatgacgcagaggaagccaggagaaaacagtcaatggctagtcatcactgattcacagtggaagctggaccttgaagctcccctaacaaataatgtagcaattgttgagagtcctcatggtcatgggataatgcttggcagtcaacaggggctcacattctgaaataaatgtaaattgtttgcctagactgtttaaaaacatgtttaaaatggtacttccagaccaatgatgagaatgtgtcctgaaacaggtattattactgatttaattctgtgctcctgaagtttattttaaaaatagcatattgtaaaggagataatcctagattgtgtgggtatagtgtgtgcatttctatatgtacatagcagtcataaagtaatattctgggcaccacaaatctaaaaaacgtccaagtcatggaatcatagtagagatgtcaaagggagggaaagggtgagaaaagggtgaactgaaaaaacctgatagtattatttcttcctgctcagggttaataatatagtaaaaagagatttttattacatacaactagaaaggaccaattagagtgtggaaagtgttcctttgcatagtcaaatgataggcaggggaatataatttcaccagaaattactatagcgagtttcaataaaggactgcagaacaataaggccttgttaatcccatactggtctgttcaaatagtgtgtaattcaaagcaattgctgctccctaggcaggaatttacaattgctacatgtgaagggaggataatgtgtcattccaaggggaaatcaggttctggaaagggcctcctggctgcagaactgtatgtgtccccaaacagctccacagcaggccaagttaaacaaaataagtagagaaccaccctgtgaaatgagtctgcttcgaattgatctgtatttgccttgctctctcctgcctttttggtggatgacaaaatgtccccaaaccaaggatcaagaggggaaggcagagaaactcagacctgaataagctatcacttagaaattgactgcctccaccagtgcacggtggctcacgcctgtaatcccagcactttgggaggccaatgcaggcagatcacttgagctcaggaggtagagacagcctgggcaacatggtgaaaccccatttctaaaaaaaatgcaaaaattagctgggcctgctggcacatgtctgtagtcccaactacttgaggagtgctgagacaggagaattgtttgagcccaggaggttgaggctgcagtgagccatgttcataccactgcacttcagcctgagtgacaaagtgagaccctgtcttaaaaaaaaaaaaaaaaaaaaaggcaagaaaaagaaaaagacagaaaaaagaaagtgactcctcccaccctactcccctacttggcaagggcatacaacttcattcaagtgaactgcagcctacatgtacggactgtatgtatatttaattgataatagtgatgcatacagagcaccatccc

SEQ ID NO: 465575 - DNA, 2166 bp, Homo sapiens
cgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccct

SEQ ID NO: 465576 - DNA, 1051 bp, Homo sapiens
  misc_feature (32)..(32): n is a, c, g, or t
  misc_feature (34)..(34): n is a, c, g, or t
  misc_feature (39)..(43): n is a, c, g, or t
tgtgttctcattgctcaactcccacttataantnagaannnnnggttcttcatcccacttctcaatggctctcagttgaccacctcatctcatactttattcacaaaattggcagtgtcagtaaaacatcctatatcatcctactcatacacattacaaagttgcctgcctcctctgcccaagtctcagagggcaagttcttcctgccctcatcaccactgggaacctactccctcctgctccctctgcaattggcttcatcaatctttttcttgttttcctttaccttcaacctcaccttcttcattgagccctcctctagtatctacagacctgctcatgttcctctcaacctaacattttatgccttgtatatttcaaaggaagctagaaatgcagatttcttgagatacctctcaattcttaactgttggcaactatttttaaaaaatattgtaaacactggtgagggaaacaaaatgaaaatttgggccaacttggtccaaaggctgtggatgagtgcccatggattccatggctgaatttgcttggttttctttgggaatctttggtttttgctgctggtggttgtttgcgggcaccaccacgccctgctaatttttcttttgtgttgtttgtagagacggggtttcaccatgttgcccaggctggtctagaagtcctgggctgaagcgatccgaccgcctcccaaagtgctgggattacaggagtgagccatctcgcccagccgaaaaagtgttttttgatcttaaaatcttacgtggaatgaaagtgaacaatgaggcaatgaaagtggaagtttctcttaagcaaacacagaagtcaaccattccagctttctaaggtactggtaatactctttcgtctattttattttatggcataattttaagactcctgtgagctatgtctttaggggaagtttgggaaggacaggcagagtgtcaatactaaattaacatcagtttaatttccgcccatggttatctgggcctcattccagcattaagactttcagaaaaaacattga

SEQ ID NO: 465577 - DNA, 1434 bp, Homo sapiens
  misc_feature (32)..(32): n is a, c, g, or t
  misc_feature (34)..(34): n is a, c, g, or t
  misc_feature (39)..(43): n is a, c, g, or t
tgtgttctcattgctcaactcccacttataantnagaannnnnggttcttcatcccacttctcaatggctctcagttgaccacctcatctcatactttattcacaaaattggcagtgtcagtaaaacatcctatatcatcctactcatacacattacaaagttgcctgcctcctctgcccaagtctcagagggcaagttcttcctgccctcatcaccactgggaacctactccctcctgctccctctgcaattggcttcatcaatctttttcttgttttcctttaccttcaacctcaccttcttcattgagccctcctctagtatctacagacctgctcatgttcctctcaacctaacattttatgccttgtatatttcaaaggaagctagaaatgcagatttcttgagatacctctcaattcttaactgttggcaactatttttaaaaaatattgtaaacactggtgagggaaacaaaatgaaaatttgggccaacttggtccaaaggctgtggatgagtgcccatggattccatggctgaatttgcttggttttctttgggaatctttggtttttgctgctggtggttgtttgcgggcaccaccacgccctgctaatttttcttttgtgttgtttgtagagacggggtttcaccatgttgcccaggctggtctagaagtcctgggctgaagcgatccgaccgcctcccaaagtgctgggattacaggagtgagccatctcgcccagccgaaaaagtgttttttgatcttaaaatcttacgtggaatgaaagtgaacaatgaggcaatgaaagtggaagtttctcttaagcaaacacagaagtcaaccattccagctttctaagacagggatctggctctgttgcccaggctggagtgcagtggtatattcatagctcactggaacatcgaactcctgggctccagtgatcctccccaaagcacagggattaaaggcaggacccacctcaccctcagatctcacccagcttaaaggatgcagttacagcagccatctcgaaccatgaggttgccgtgcacatggaaaccttttagcggggggagtggtagctcagcctgttttcccagcactcttgagaggccaaggtgggaggatcgcttgagcccaggagtttgagatcagcctgggtaacatagtgagaccctctctacaaaaaataaaaatattacctggacgtggtgacttgtgcctgtagtcccagctacttaggagggggaggtgggaggatcgcttgagccaaggaggtcaagactacagtgagctatggtcacactactgcattccagcctaggcaagaaagcaaaaccctgtcttaaaaacaagaatgaaacaaaccatttggtagatgatagaatgggaaggtactttttaaaaaactcatcttttcacatg

SEQ ID NO: 465578 - DNA, 960 bp, Homo sapiens
cgccgaaagcaagcgagggctctgaggactgccagcatgctgtcacctgtgccggatgctgtccacaagtgacatgattgtggcctgtctcgctgcctcccgtttctgcctgcatggggtagccatggtgaacaacctcctggcctccttagatttttcgcgtgcagttccctatatgaacatcttctgggaccttttcaatgccctcactttgtggtttactgccttgcttgctgctttctactgtgtgaagatctcatctttctcccaccccaccttcgcctggctgaagtggaggaactctcggttagtgcccaagctgatcaagggctccctgatcatctgtggcctggaagtcatctcatcagccactgggaacatcctgtttggtcagaggaaggtctccctgagttcctacagaaacgaaactctagtttatagagtgcaggcttcatttcagctctactttttcctttatgaagggtttgtgtggtcgattctgttcctcctgttcctagtgtccactgtcttgctcatagtctcactgtgctggcagttggggtagatgagggacctcaggcccggcccctgtgatcccagcacccaggcttacactatggctttaaagtcactcaccttttccctcatcttctgtacattgtacttcctgtccttgtttgcttctgctttgaaaatcataaactttcagaatcactggcactgggcctggtaagtgctaatctatgccaacatctgtctgcactctaccgtcctggtgctgaggagccccaaactgaaaaagggcctgaagacatggcctcagctccagtgcccacgtgctgctggctcacagggctttggaaggtgctggccatagggtggttctgctcctgagttatctgtgtcagtaaccagtcctgggatgaatgatcctggtaggaatgtataaggtttgggtac

SEQ ID NO: 465579 - DNA, 474 bp, Homo sapiens
  misc_feature (5)..(5): n is a, c, g, or t
aaacngttgctgcaaccctctcttaatttccaccgctacagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagcaggtggttgtctgctgcgttcctttacagaacagatgctgagcctgcctggaggtggcaatttaccaatcgatggtcttaagcaattccaaaggctggggtctgctccctgcccactcaacttccctctgctctccacttctgagacagtttgggtcacctacagacctcatcccagccggatccaggaatgctgccctgaagtgtggaattccttagga

SEQ ID NO: 465580 - DNA, 1408 bp, Homo sapiens
gctgtctgcctcatcataatccagtaaggtgttaagctgctcactaagaattccctgccctggcttgactccccatcccagctggtgttatgggcgagacctcagtgatccaacaccttggtatccaaatgagcagttgccgcatcacctatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgagtaagtaccggtggggccccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagggtccgagtcagccgctccacagatgccgcgggcctgcgtctcagtcaagtcccacgacatgactctggttctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagcaggtggttgtctgctgcgttcctttacagaacagatgctgagcctgcctggaggtggcaatttaccaatcgatggtcttaagcaattccaaaggctggggtctgctccctgcccactcaacttccctctgctctccacttctgagacagtttgggtcacctacagacctcatcccagccggatccaggaatgctgccctgaagtgtggaattccttagga

SEQ ID NO: 465581 - DNA, 1216 bp, Homo sapiens
tgcttgtaatcccagctctttgggaggctgagggacagagggccagggaaggcccaagtcacagccagggtggccgagtcaggtccagaatttgtgattcccacacccacgttccttccgcttttccacactaccttctcttatcagttgtcaaagaaggatgggcgagttggccctcagctgggctggatcccaggtgtccagtgctgttaagtcccaagtatggtgcatttcacagcactgctgtgttcggtgtgttggcttcattcccgaccccactcaagacaaagtggcgtcgctgtcttccctggtcctcacattggaaccacatggaggggctgatattctgctggaggacatccgcaaagaaataaaggagctagctgtgagaggtggcagagggagcagcaagttcaagggccctggggtgggctgtgctagcatgtgcaaggaacagtacagagaccgtgtggctggaaccaggtgtgcaagggagagaggggaaggcaataagagatgtctcctgggctggcgagcctttgccaaggtcctggagaagactcaggatggagaggaggagccagagagacctggaaaggaactggtgggaaggagaggtgttgtccacagcagggatggagtggcaggcggctggtgctgcaaagaagccagtagggctggaaaggagaggtcgaggagaagtgggcaggggccagatctcacgggccagggcagccctggcaagaagtttgcatcttatcctgtgagccatgagcagccagggaaggtgcggcaggtgagcacaggactggcactaagagcaccctgggccaatgccacagtgttgtttgtctacagcaagctttgcatatcaaaacgacattaaaatctaaatgtctcatggcactgaacagcaacattagagtctcctcccagctgacacagtggggtgagtgctgtccacgctcatgcaggtgagctggcacccactctgccaggtatgtgagcctggcatggttacataccccataatttgagtgacacttgtcaatcaagtttggcatgggttcttctgccattactgcctctgctgatgaacagagttgcaccatcatggctgttgaaaagcaactgagtggtggttttggggcctgcaaaagtgccatgggaaccagccttccactgggtgttaaaaacgcgtgtgtcacaaccactc

SEQ ID NO: 465582 - DNA, 1998 bp, Homo sapiens
gtccttagcctcctgagcttatagtgtggtgtatgcttcccccttctggccacaaatggtcaacaatgatttttggtaatccctggtgggaggccctgcttactgctgggaagtggaccttcctagtaacagcgacgacaatgatactgttgccagagctattgatggaagtggtacaatccaataggtgcagtaaaaagccctttacatacactgtctcatttaatcctcaaagccaggggtctccaactcccggggccacagaccggagcatgaaccctactgtgaactgcgcatgcgagggatctaggctgcgcgctccttatgagaatctaacgcctgatgacctatcactgtctcccatcactcccagatgggaccgtctagttgcaggaaaacaagctcagggctcccactgattctacattatgatcaactgcatggggtcctacaggagaagaccaagagacagagacagagaccagggaaaatgaccgataccattccttctcagggatgctacacacccatggggcagaggataagaggttcctgaaggcatcacccctctggccatggctggtgtgcagacaaagctggagatttggagtagcctgttgtcccactgactcttagactgccccagctaagaagaaccaactcctcctattacagatgaaataaacaaagctactcaagctctctggcatcgccctgacggtcatcatgtgcttcacatttccctcctgccccccctgattttctggaaaagggagaaacacaccaaagagagttctagaaaaaatgagaataagaaatttacctgtaatccttgctcaagaaactgaagctctgaggccacattgttccagccttttgcagctcctgcatgtggataccagcaccagcagctccccgaccaggggccccagctaagccctcccagaggatgatcttggctttgtacatggggtgtcaatatcctgtgagtccaacagagggaagacataagaatatggtcacccaggtaagtggtggatagctgagtgactgtattcttgctcaccaccacccccatcagagggggtgtctttgtttctagttgggggaagctttggtagactgtcagtaattcctccctgtgtcccccatcctgtgtcaggtaacagacatttgtcttaatgtattcactgtgtcatcagaagccacttcttatccatccttgtgaatacttgatgaatgaggagtcaatgattaaatgaaggaaagaaaagagactgaaaaggaggtatgagaatgggaaagacgagtggaaagacgagatagatattgccctaaagacacagtaagccatcaaatatctgttttctagtccccttctgggccctcttggattttgaaaaagggaggaagaaattggaaaaattaccaataacttctattgactttgtagattcctagtttccccacatgtggctatgcttgaatcaacttgtaaaagtctctttatagtctgttgatgttcatgcaggcactaaaaggccacggtcggcctacttagatgatccactccaccctgggctccggaagatgttccagggcatttgcctttacttgaccctatgctgagaagctaccaatatttttctttccccaaattggttttatttgtaccctttatatattaaatattagagtattggccaagttgaaggagtcttcttctatggctggtttcaataaacatggtggaataaatatatatatcatatatatatagtatacgtatatatattttatatatatagtatatgtatatacattatatatatagtatatgtatatattatatatatagtatatgtatatattatatatatagtatatgtatatatattatatatatagtatatgtatatatattatatatagtatatgtatatatcttatatatagtatatgtatatatcttatatatatagtatatgtatatatata

SEQ ID NO: 465583 - DNA, 1073 bp, Homo sapiens
gtccttagcctcctgagcttatagtgtggtgtatgcttcccccttctggccacaaatggtcaacaatgatttttggtaatccctggtgggaggccctgcttactgctgggaagtggaccttcctagtaacagcgacgacaatgatactgttgccagagctattgatggaagtggtacaatccaataggtgcagtaaaaagccctttacatacactgtctcatttaatcctcaaagccaggggtctccaactcccggggccacagaccggagcatgaaccctactgtgaactgcgcatgcgagggatctaggctgcgcgctccttatgagaatctaacgcctgatgacctatcactgtctcccatcactcccagatgggaccgtctagttgcaggaaaacaagctcagggctcccactgattctacattatgatcaactgcatggggtcctacaggagaagaccaagagacagagacagagaccagggaaaatgaccgataccattccttctcagggatgctacacacccatggggcagaggataagaggttcctgaaggcatcacccctctggccatggctggtgtgcagacaaagctggagatttggagtagcctgttgtcccactgactcttagactgccccagctaagaagaaccaactcctcctattacagatgaaataaacaaagctactcaagctctctggcatcgccctgacggtcatcatgtgcttcacatttccctcctgccccccctgattttctggaaaagggagaaagtgtgtgaaaaaaaatggacaataacttctgttaactttgtagatgtctggttcctccatatgaggctgtgcttgaatcaattttggagagagggtttctaaagtctctctagattctattaattttgatagagacaataaaaggcagcaggaccaactctgtgtggtgggagatctagcaaccattatagtcacaatagccaccacttactgaacacccaccatgtgacaaagaacaatgtgctgaattatgtcacatttttcacaagcaccccttgagttgggagttcactc

SEQ ID NO: 465584 - DNA, 2063 bp, Homo sapiens
agctgctgtggagatgtttggaaagggtcaaaagagaaagtaggctgacccattaggaaatgtttgcagagttcagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagaaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtgtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagaatttccctaaagctaacctactaaaaactatgactagatttcatatgtgctataaacattctttatttaaaataaattactctaattcagaaaggaataacatttgcttgcacatttagaacatctggcattagagactataaaattcatatatagtctcaaatacttattagacatattcttaattcaagaatatataattattcatatgattagaaataattataattttactaaacattgctaattaggcagagtacaaacaagaaaaagtcagaaggaaaatagaaccacaatttgcaatatatttattttaaaacatttttagctttctttgttacttttaaaagtaaaacttgtaagtcaatatattattaaaactactagttaatctttaagtctacaggtgctactaagaaattgcaatttgtaacttaacagagatattaaattctgtagaattgttaccacattcaagcatttctattctgtaggtataactcatttcccatgtttctctgctatttatctttttgctgaaataatttactccttcagtagtcatttcaccctttcacccttctgtgtttttgtgtcataacagaagaatcactaaataatgattaaaattaagtcaacataccaaatataaagttaaagcttttatgaagcttaatctttgtgcactt

SEQ ID NO: 465585 - DNA, 1189 bp, Homo sapiens
tatagacgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtgtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcagaatttccctaaagctaacctactaaaaactatgactagatttcatatgtgctataaacattctttatttaaaataaattactctaattcagaaaggaataacatttgcttgcacatttagaacatctggcattagagactataaaattcatatatagtctcaaatacttattagacatattcttaattcaagaatatataattattcatatgattagaaataattataattttactaaacattgctaattaggcagagtacaaacaagaaaaagtcagaaggaaaatagaaccacaatttgcaatatatttattttaaaacatttttagctttctttgttacttttaaaagtaaaacttgtaagtcaatatattattaaaactactagttaatctttaagtctacaggtgctactaagaaattgcaatttgtaacttaacagagatattaaattctgtagaattgttaccacattcaagcatttctattctgtaggtataactcatttcccatgtttctctgctatttatctttttgctgaaataatttactccttcagtagtcatttcaccctttcacccttctgtgtttttgtgtcataacagaagaatcactaaataatgattaaaattaagtcaacataccaaatataaagttaaagcttttatgaagcttaatctttgtgcactt

SEQ ID NO: 465586 - DNA, 1142 bp, Homo sapiens
agctgctgtggagatgtttggaaagggtcaaaagagaaagtaggctgacccattaggaaatgtttgcagagttcagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagaaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagagagctgcaggggatactctagaatcaactatcaccc

SEQ ID NO: 465587 - DNA, 2684 bp, Homo sapiens
gaagcaggtagcccagggagcccaagggggcaacgatggatctggatgggaaccacatgaccagctttttgttagagaaatttcaagaagtcatccacagtagagagcagggcaccgagaacccacaggaagtaaaagaagtacttttaccttttacagactaccggctgctgtgtcccagtcactcattaaatcctatggaggaggcactattaggtccttctgaagctgcaggctccccaccctgtgagagctttcgtgtgccaagtcattggctacaggtggcaaagttgtggctccagttcaagtctctcccctggagctggatgttccagaaaggacactcagttcttcagggctgtctctgtgatccaggctttgatctgggaaaggttgcgcctcattgcagagttgaagctatctgcctgctttgtttacacgaacgcccttccaggactctgtctgcttttggggtggaagtgccctgccaaaaactccagctctccatgctggctgtgtggccagcatacctcctgccttttcaacgattcctctgccctggatagagagcggtgtctcataacagtttggaaactacaaaagtttccctggcaggatgaatgattgactcggcaacatgttcttgccttttggagttgccctccaatttttccaggcttgattctgtaaatcatttcatcttgtaaaaatactgggctgtgagcacggatgatctcaaaggtgaggattatttgaaactccatttgaaaatctatcctcctttcaacagattattcttgtgaataaaaattttcttgtgagcatgccagtacacaggtagttctagggcctttgagaggaagtagaatacgcttctgctccaagaggctttggaaaaagtaacttgtctatatattgacaactaatttatcatcgaaaacattaggcctgctctctgcaagtgctcctgggaggtgttggggaatgaagtggggaaaattcggaaatgttttgaaagatatgtcaaacccataaacctgaaaatgtcattcagaatattctgttgctttctgccatcccaaggagatggaaatctgtggttttcaagataggttaaggttatgtaactcacagagttggaagaacattttgggcaatgatttgaattattgcttgttgtagtttttgctcatttttccctttttccaacaatgagagagaatcggttgaaggcaggctgtgacagagaaggtccaacaaccataagttgatggatgatatcagagaggaagcttctttgacatctctgctcttctttaacttgctgaccaaagagtagcccatgtgcaattgccatatgcttttgaaatgaacattcatgaatattagaaattatcttgctggtttttggagtgaaggcaaatgtgcctacttttcagccatacttaggagacctaactcattttttagagtatctacaatttagtgtgatccaatgagttaaaaaaaatgtacccaaatattcggtttaaaattttgttttagatatgaaatcctttcatcaagctataccctagaaaggtaatttcataaagtatatttgtaatgttataatgattaaaactgatcacaacgtgatataaatggattagctaggggagagaaaagaagacctgaaaatcttctatatgtttgtgaagcattaaaaaaaatgacattccatttaactctcacaaaattttttcttttttgcagatgaggaaacagaagctgggatattaaaactagtactaatgcagaagtctgaaattagactttaaaaacgagtactactctttttttccccctttttgagagagctggtgattttcttccttgcttggcattaactgtcttactgtcttatgatacttatctttaatgtggcatatcagagaacctctttgaaaatgttacggcttaatgcggctcagggaaataaaagcccactttaaaaaagccaaaataaagctttctgatacggacttcacaattaatttttgagaaggtccactttcatatgcaagcaaatctgtttagaaatgttttaaattttaaagcatgcatacacatataaaactaatttatgtgtttttaaatgctgtttaaaattttaaagcatatatagagagcaagagagcaagagagggtgctcaatatgcatcataatagcatgagaactgaaaaataaaagtttacttgcaaacttaaccggctttgcaatgcaacagactaaacaagtcacattttatacaatgtatatgtttataatatgagtgcagcatgccaatgtgctatttagatcattgtcctggttgaatgaacaagctcacaggttcaccatttaatatttgttctcttaaaaacatgaaactcgttttgaaaataccggcttaaatgggcattattaagtctttatcagttctaagcatttcagccttttgcatccagaaatttctcaatctgacagaataagaaatgcatttacatggcctaagctcttaaattgtccctttcaattaatgccccatcatggagcaatctggaaaccattactcagtaactcttcattataattgcttgcagctgagtatccagcccttggtaatataagaataaaagaaaactcagttagtaacaagtgc

SEQ ID NO: 465588 - DNA, 1806 bp, Homo sapiens
agtgcgcatggataaccacatgtatatactggaggaggccgctcttctaacttcttactcccgttgcaattccagatattccagagacaggatatctccaaggcactccagggccccaaataacaaaccttatttgttttccacctcacacaatctgaactcttctgcctgccctttgaaacccttcgcgaacacctccaaccttatttcttgctcctcctcaatacagcctgttctggttggcacagcctcacctcttacctttgccacgatgctactcctgctgcgtcactcagttctgcatgcgtcagcctccctcgggcctcggcagcggcggcggctcgctcgcctcagccccagcgcccctcggctaccctcggaccaggcccgcagcgccgcccgccctcggccgccccgacgccggcctgggccgcggtcgcagccccgggctcgcgtaggcgccgaacgctcccggcccgcccactacgggcccaggctagaggcgccgccgccaccggcccgcggagcccggatgctggcccggaggaagccgatgctgccggcgctcaccatcaaccctaccatcgccgagggcccgtccccaaccagcgagggcgcctccgaggcaaacctggtggacctgcagaagaagctggaggagctggaacttgacgagcagcagaagcggctggaagcctttctcacccagaaagccaaggtcggcgaactcaaagacgatgacttcgaaaggacctcagagctggacgcgggcaacggcggggtggtcaccaaagtccagcacagaccctcgggcctcatcatggccaggaagctgatccaccttgagatcaagccggccatccggaaccagatcatccgcgagcaccaggtcctgcacgagtgcaactcaccgtacatcgtgggcttctacggggccttctactgtgacagggagatcagcatctgcatggagcacatggatggcggctccctggaccaggggctgaaagaggccaagaggattcccgaggacatcctggggaaagtcagcattgcggttctccggggcttggcgtacctccgagagaagcaccagatcatgcaccgaaatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggtcatctggagcatggacctgtccctggtggagctggccatcgaaaggtaccccatccccccgcccgacgccaaggagctggaggccatctttggccagcccgtggtcgacagggaagaaggagagcctcacagcatctcctcttggccagggtcccccgggcgccccaacagcggttacgggatggacagcctgcccgccatggccatcttcgaactgctggactatattgtgaaagagccgcctcctaagctgcccaacggtgtgttcacccccgacttccaggagtttgtcaataaatgcctcatcaaaaacccaacggagcgggcggacctaaagatgctcacaaaccacgccttcatcaagcggtccgaggcttgccttctctcaaaccatcaggcaaaacataccctgatgaacacatcaaattcagcatcaaagtggacgcttacaactttaatgctcactacgaattaacctcaaaatagctacgtaaataaaattagcaggattatcagagaattgttcaaata

SEQ ID NO: 465589 - DNA, 2012 bp, Homo sapiens
agtgcgcatggataaccacatgtatatactggaggaggccgctcttctaacttcttactcccgttgcaattccagatattccagagacaggatatctccaaggcactccagggccccaaataacaaaccttatttgttttccacctcacacaatctgaactcttctgcctgccctttgaaacccttcgcgaacacctccaaccttatttcttgctcctcctcaatacagcctgttctggttggcacagcctcacctcttacctttgccacgatgctactcctgctgcgtcactcagttctgcatgcgtcagcctccctcgggcctcggcagcggcggcggctcgctcgcctcagccccagcgcccctcggctaccctcggaccaggcccgcagcgccgcccgccctcggccgccccgacgccggcctgggccgcggtcgcagccccgggctcgcgtaggcgccgaacgctcccggcccgcccactacgggcccaggctagaggcgccgccgccaccggcccgcggagcccggatgctggcccggaggaagccgatgctgccggcgctcaccatcaaccctaccatcgccgagggcccgtccccaaccagcgagggcgcctccgaggcaaacctggtggacctgcagaagaagctggaggagctggaacttgacgagcagcagaagcggctggaagcctttctcacccagaaagccaaggtcggcgaactcaaagacgatgacttcgaaaggacctcagagctggacgcgggcaacggcggggtggtcaccaaagtccagcacagaccctcgggcctcatcatggccaggaagctgatccaccttgagatcaagccggccatccggaaccagatcatccgcgagcaccaggtcctgcacgagtgcaactcaccgtacatcgtgggcttctacggggccttctactgtgacagggagatcagcatctgcatggagcacatggatggcggctccctggaccaggggctgaaagaggccaagaggattcccgaggacatcctggggaaagtcagcattgcggttctccggggcttggcgtacctccgagagaagcaccagatcatgcaccgaaatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggtcatctggagcatggacctgtccctggtggagctggccatcgaaaggtaccccatccccccgcccgacgccaaggagctggaggccatctttggccagcccgtggtcgacagggaagaaggagagcctcacagcatctcctcttggccagggtcccccgggcgccccaacagcggttacgggatggacagcctgcccgccatggccatcttcgaactgctggactatattgtgaaagagccgcctcctaagctgcccaacggtgtgttcacccccgacttccaggagtttgtcaataaatgcctcatcaaaaacccaacggagcgggcggacctaaagatgctcacaaaccacgccttcatcaagcggtccgaggtgaaagaagcggattttgcctgctagttgtgtaaaaccctggggctgaaccagcccggcacacccacgcgcaccgccgtgtaacagtggccaggctccccgcgtcccgctggtgacctgcccaccgtccctgtccacgccccgcccttccagctgaggacaggctggcgcctccacccaccctcctgcctcacccctgcggagagcaccgtggcggggcgacaactgcgcacgcaggaacgggggtctcctctcctgctggtccctgccggcgtgcctctagggacgggcgacgctgctgtgtgtggtctcagagcctctgcttccttaggttacaaaacaaaacagggagagaaaaaccaaa

SEQ ID NO: 465590 - DNA, 1672 bp, Homo sapiens
gtacaggagcggtggggagacagaccgaatcccataaagtgtgacctcctgccactgccacagccagggcagagtgcccttcggggctacacagctccccccaccaccccaatcattacaggagaaagcaaattggtggaagaagagggagagaaagaggcagtgctggcccacggggatggcagctgggggtgaatccgggcgaccctccctccatccaaccgtcggcgctcgcagggcgttgagagtgcttcacacaaacggagagaaatgtgccttcagaagctcccctaccgagtgggcctgtcttagggaggaattacttcctacagctaatccagagttcccgccccctgcaacaaaacccacagcagcttctcctccggtaaagccgggatctgagcagacagtcactcctgtgggcagcgctggctggaaaggacactggagcaggccgcgcctgggccttggagacacgcacaggaccctggaggaggccacacctgggcctcgggaacgcgcacaggaccccggaggaggccacacctgggcctcgggaacaggcaccagcagaggcaggactggaaaggacaggagaggctgggcccacatttaatctctgttccctctccctccacagtggtgcctttatttctagaagcaacgaaggaaacacagtagactcagagccagaagaggaagaggaggccagctcccactgctgcagcactcagctggggtcagcggggctgtagtgatggtagtgatggtaggtagtgatgggtagtgatagtaggtagggatggtagtgatagtagtgatggtaggtagtgatgatggtagtgatggtaggtagggatggtagtgatggtagtgatggtaggtggggatggtagtgatggtaggtagtgatgatggtagtgatagtaggtagtaatggtagtgatggtaggtagtgatgatggtagtgatagtaggtagtaatagtagtgatggtaggttgtgatggtagtgatggtaggtagtgatgggtagtgatggtaggtagggatggtagtgatagtagtgatggtaggtagtgatgatggtagtgatggtaggtagtcatggtagtgttggtaggtagtgatggtagtgatggtaggtagggatggtagtgatggtacgtagtgatggtaggtagggatggtagtgatggtaggtagggatggtagtgatggtagtgatggtaggtagggatggtagtgatggtaggtagtgatgatggtagtgatggtaggtagggatggtagtgatggtaggtagggatggtagggatggtagtgatggtaggtagtgatgatggtagtgatggtaggtagtgatggtagtgatggtaggtagtgatggtagtgatggtaggtagggatggtagtgatggtaggtagtgatgatggtagcgatggtagggatggtagtgatagtagtgagggtaggtagtgatgatggtagtgatggtaggtagggatgatggtagcgatggtaggtagtgatggttgtgatagtagtgatggtaggtagtgatgggtagtgatggtaggtagtgatagtaagtagcggtggtagcatggggatgctgccgtgaagcagaggaggcttcacaattctgattgtgaaggcttcagaactctga

SEQ ID NO: 465591 - DNA, 3949 bp, Homo sapiens
tgtgcattgtttacgaatgcacacatgttagttaatgcataaagacctggttccagttgggcttcatcgctagtaaccaggacgcctgcctatagtttcttctttttttttccttttcaattcatccccagttctcgccacctcgtaggtattcaattaatacatgtttaagtggacctgtccaggaaggggagttctcaactctaagctcctgcatttcttttgggacttctcatggttacaaagagcattcattcatactgtgactgagggtaaacaagtcgctgcccactcggcctcagtttcctcctaaatgacccgtctggccacttccagccccagcagggtctgattctaggaattcggtcctttcatgtcgaaaacaacactcgggcatttcacaaaagcacccaaccccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccggcacgtcgcctgggctgcgcgctccgactgcgcctccgcccgcgcgcctcccggcctcgcccgagggtgcctgggcaggcgaggaccccaggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggctggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagctaggaaaccccgcagtgaaaaggctggcgccctccgtgcacggtgagcggcacctgagcgagaaccgcggggcctcgagccagcagcagcggaaccggcgcggcgagcggcccttcacatgcatggagtgcggcaagagcttccgcctgaagatcaacctcatcatccaccagcgcaaccacatcaaggaggggccctacgagtgcgccgaatgcgagatcagcttccggcacaagcaacagctcacgctgcaccagcgcatccaccgcgtgcgcggaggctgcgtctcacccgaacgcgggcccacgttcaaccccaagcacgcgctcaagccgcgtcccaagtcacccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaagagcgtttcctgtttgccgtttttgtttggtttgaaggggagggattgagaaggccggagggacatacgctagtgtcagttgacaggttctgttgggacccttttttgtgttccttctccatttgggtggtgagggagacgctgatcccgccggttctgaaatggaggaggagaggcaggactgacgtctaagggaccacgggaaccccagaccatcgcgtctgccctggagtccatgaggttgctgggagctcaggactgaataggtcccagttgactagcgtggtcaaggagagtgac

SEQ ID NO: 465592 - DNA, 4312 bp, Homo sapiens
tgtgcattgtttacgaatgcacacatgttagttaatgcataaagacctggttccagttgggcttcatcgctagtaaccaggacgcctgcctatagtttcttctttttttttccttttcaattcatccccagttctcgccacctcgtaggtattcaattaatacatgtttaagtggacctgtccaggaaggggagttctcaactctaagctcctgcatttcttttgggacttctcatggttacaaagagcattcattcatactgtgactgagggtaaacaagtcgctgcccactcggcctcagtttcctcctaaatgacccgtctggccacttccagccccagcagggtctgattctaggaattcggtcctttcatgtcgaaaacaacactcgggcatttcacaaaagcacccaaccccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccggcacgtcgcctgggctgcgcgctccgactgcgcctccgcccgcgcgcctcccggcctcgcccgagggtgcctgggcaggcgaggaccccaggtgagaggccggagggtcctggagggtgggaggccccggcggttcggcccgggctccacgacgggctggcccgggctcagggcgtgtccgtcgccgccgggcggctcgctcgacactgttcgctcctaccggctgtagatggagctgtctgggttccggcagcctccgacgagcctcggagtgtttctctttaaacggcctgagagggacatgcctcccaggatgcagtttgtagcaacatggcagctgctgtgcagctccccggctcctgtgagggcggcccgcgcgcgcacggacgcgcggcctcggggccccggggacggcctgcgtgtcccgggctcggcggcccggcctgggatctcggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggctggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagctaggaaaccccgcagtgaaaaggctggcgccctccgtgcacggtgagcggcacctgagcgagaaccgcggggcctcgagccagcagcagcggaaccggcgcggcgagcggcccttcacatgcatggagtgcggcaagagcttccgcctgaagatcaacctcatcatccaccagcgcaaccacatcaaggaggggccctacgagtgcgccgaatgcgagatcagcttccggcacaagcaacagctcacgctgcaccagcgcatccaccgcgtgcgcggaggctgcgtctcacccgaacgcgggcccacgttcaaccccaagcacgcgctcaagccgcgtcccaagtcacccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaagagcgtttcctgtttgccgtttttgtttggtttgaaggggagggattgagaaggccggagggacatacgctagtgtcagttgacaggttctgttgggacccttttttgtgttccttctccatttgggtggtgagggagacgctgatcccgccggttctgaaatggaggaggagaggcaggactgacgtctaagggaccacgggaaccccagaccatcgcgtctgccctggagtccatgaggttgctgggagctcaggactgaataggtcccagttgactagcgtggtcaaggagagtgac

SEQ ID NO: 465593 - DNA, 3968 bp, Homo sapiens
tgtgcattgtttacgaatgcacacatgttagttaatgcataaagacctggttccagttgggcttcatcgctagtaaccaggacgcctgcctatagtttcttctttttttttccttttcaattcatccccagttctcgccacctcgtaggtattcaattaatacatgtttaagtggacctgtccaggaaggggagttctcaactctaagctcctgcatttcttttgggacttctcatggttacaaagagcattcattcatactgtgactgagggtaaacaagtcgctgcccactcggcctcagtttcctcctaaatgacccgtctggccacttccagccccagcagggtctgattctaggaattcggtcctttcatgtcgaaaacaacactcgggcatttcacaaaagcacccaaccccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccggcacgtcgcctgggctgcgcgctccgactgcgcctccgcccgcgcgcctcccggcctcgcccgagggtgcctgggcaggcgaggaccccaggtgagaggccggagggtcctggagggtgggaggccccggcggttcggcccgggctccacgacgggctggcccgggctcagggcgtgtccgtcgccgccgggcggctcgctcgacactgttcgctcctaccggctgtagatggagctgtctgggttccggcagcctccgacgagcctcggagtgtttctctttaaacggcctgagagggacatgcctcccaggatgcagtttgtagcaacatggcagctgctgtgcagctccccggctcctgtgagggcggcccgcgcgcgcacggacgcgcggcctcggggccccggggacggcctgcgtgtcccgggctcggcggcccggcctgggatctcggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggctggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagcagaggaactgcacggaggggatcgtgatcaagacagaggaacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaagagcgtttcctgtttgccgtttttgtttggtttgaaggggagggattgagaaggccggagggacatacgctagtgtcagttgacaggttctgttgggacccttttttgtgttccttctccatttgggtggtgagggagacgctgatcccgccggttctgaaatggaggaggagaggcaggactgacgtctaagggaccacgggaaccccagaccatcgcgtctgccctggagtccatgaggttgctgggagctcaggactgaataggtcccagttgactagcgtggtcaaggagagtgac

SEQ ID NO: 465594 - DNA, 1065 bp, Homo sapiens
tgtgcattgtttacgaatgcacacatgttagttaatgcataaagacctggttccagttgggcttcatcgctagtaaccaggacgcctgcctatagtttcttctttttttttccttttcaattcatccccagttctcgccacctcgtaggtattcaattaatacatgtttaagtggacctgtccaggaaggggagttctcaactctaagctcctgcatttcttttgggacttctcatggttacaaagagcattcattcatactgtgactgagggtaaacaagtcgctgcccactcggcctcagtttcctcctaaatgacccgtctggccacttccagccccagcagggtctgattctaggaattcggtcctttcatgtcgaaaacaacactcgggcatttcacaaaagcacccaaccccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccggcacgtcgcctgggctgcgcgctccgactgcgcctccgcccgcgcgcctcccggcctcgcccgagggtgcctgggcaggcgaggaccccaggtgagaggccggagggtcctggagggtgggaggccccggcggttcggcccgggctccacgacgggctggcccgggctcagggcgtgtccgtcgccgccgggcggctcgctcgacactgttcgctcctaccggctgtagatggagctgtctgggttccggcagcctccgacgagcctcggagtgtttctctttaaacggcctgagagggacatgcctcccaggatgcagtttgtagcaacatggcagctgctgtgcagctcccctgctaaagaggcgccgggacggcagcgcagctcgcagccggggccggggccggagctggggtcccagccgcggccgc

SEQ ID NO: 465595 - DNA, 1505 bp, Homo sapiens
tcgaactaggcaggactgaagtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaagagcgtttcctgtttgccgtttttgtttggtttgaaggggagggattgagaaggccggagggacatacgctagtgtcagttgacaggttctgttgggacccttttttgtgttccttctccatttgggtggtgagggagacgctgatcccgccggttctgaaatggaggaggagaggcaggactgacgtctaagggaccacgggaaccccagaccatcgcgtctgccctggagtccatgaggttgctgggagctcaggactgaataggtcccagttgactagcgtggtcaaggagagtgac

SEQ ID NO: 465596 - DNA, 3635 bp, Homo sapiens
tgtgcattgtttacgaatgcacacatgttagttaatgcataaagacctggttccagttgggcttcatcgctagtaaccaggacgcctgcctatagtttcttctttttttttccttttcaattcatccccagttctcgccacctcgtaggtattcaattaatacatgtttaagtggacctgtccaggaaggggagttctcaactctaagctcctgcatttcttttgggacttctcatggttacaaagagcattcattcatactgtgactgagggtaaacaagtcgctgcccactcggcctcagtttcctcctaaatgacccgtctggccacttccagccccagcagggtctgattctaggaattcggtcctttcatgtcgaaaacaacactcgggcatttcacaaaagcacccaaccccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccggcacgtcgcctgggctgcgcgctccgactgcgcctccgcccgcgcgcctcccggcctcgcccgagggtgcctgggcaggcgaggaccccaggtgagaggccggagggtcctggagggtgggaggccccggcggttcggcccgggctccacgacgggctggcccgggctcagggcgtgtccgtcgccgccgggcggctcgctcgacactgttcgctcctaccggctgtagatggagctgtctgggttccggcagcctccgacgagcctcggagtgtttctctttaaacggcctgagagggacatgcctcccaggatgcagtttgtagcaacatggcagctgctgtgcagctccccggctcctgtgagggcggcccgcgcgcgcacggacgcgcggcctcggggccccggggacggcctgcgtgtcccgggctcggcggcccggcctgggatctcggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggctggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaagagcgtttcctgtttgccgtttttgtttggtttgaaggggagggattgagaaggccggagggacatacgctagtgtcagttgacaggttctgttgggacccttttttgtgttccttctccatttgggtggtgagggagacgctgatcccgccggttctgaaatggaggaggagaggcaggactgacgtctaagggaccacgggaaccccagaccatcgcgtctgccctggagtccatgaggttgctgggagctcaggactgaataggtcccagttgactagcgtggtcaaggagagtgac

SEQ ID NO: 465597 - DNA, 2263 bp, Homo sapiens
tgtgcattgtttacgaatgcacacatgttagttaatgcataaagacctggttccagttgggcttcatcgctagtaaccaggacgcctgcctatagtttcttctttttttttccttttcaattcatccccagttctcgccacctcgtaggtattcaattaatacatgtttaagtggacctgtccaggaaggggagttctcaactctaagctcctgcatttcttttgggacttctcatggttacaaagagcattcattcatactgtgactgagggtaaacaagtcgctgcccactcggcctcagtttcctcctaaatgacccgtctggccacttccagccccagcagggtctgattctaggaattcggtcctttcatgtcgaaaacaacactcgggcatttcacaaaagcacccaaccccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccggcacgtcgcctgggctgcgcgctccgactgcgcctccgcccgcgcgcctcccggcctcgcccgagggtgcctgggcaggcgaggaccccaggtgagaggccggagggtcctggagggtgggaggccccggcggttcggcccgggctccacgacgggctggcccgggctcagggcgtgtccgtcgccgccgggcggctcgctcgacactgttcgctcctaccggctgtagatggagctgtctgggttccggcagcctccgacgagcctcggagtgtttctctttaaacggcctgagagggacatgcctcccaggatgcagtttgtagcaacatggcagctgctgtgcagctccccggctcctgtgagggcggcccgcgcgcgcacggacgcgcggcctcggggccccggggacggcctgcgtgtcccgggctcggcggcccggcctgggatctcggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggctggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatgggtaaggagaagccttcgctcgctggggctgcctggacgccagctcaaagtgcattcataaacttagggagttctgaaccccagcagagccaatagttgcaagcaaggagaacagagttgtagagatcacaacaaattaaagcaaacgccctcatatacccacacacatcagtgcggcccaggccaga

SEQ ID NO: 465598 - DNA, 557 bp, Homo sapiens
gggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctgatgagaggagggaccaactggaacaatatttgcaaaatgcagccccagctgaaggcgaggaccctgcccttccttccttcttccgagggagtgagaattgcactgagcatcgaaacctggaggacgtgccagacaggaggaggaaaggaagtaaggggcagtgggccaccaattcctctcatcctgaccaatggcaaagagtcgggtgacct

SEQ ID NO: 465599 - DNA, 1200 bp, Homo sapiens
ggaagaagtgtattcagcattctaccttcttcctgattctgtgagcttagacctgcttccactttcaatctctctcattgcaggctgaagaggactggcctttcagtggccctcgtggaacggtaggaagctgagctggactctctgccacatcgttcggttcccacaacagcctgatgaagcagcagcagaaaaaatggaagccattttggttaacgggtcacatcttagcagttggcagcgtaagaagcggaaggatccactggtcagaaatggagattgaggagaagctgagagcacggagggcttcaggggagagcctgtcctttggaaaagcgggcaatttgcactcgtggtagatgagtggggaggccgctcagtctctctgcccctttgcacatgctgcacccgtttagtttgacgtcgtggagagctcctccaggcacgggctgtgtgaaagggtttaaaagtttgggggcatggctgggggtccccgcatgaggggtgctgtgtaggctcccatcttttctgccggtcatgctgggagccaacagcaccggctcctgacgtggggacttgccctgtgccatgacgtggggactcgccctgtgccctgcgccccggttcctgctggttctgtgccttctggactcatttcctttccagggtccgcaaccgcttccgacacaatcactattttggctgcggccacggcttcattcgcttcagctgcgagcttttctcagcgcagagagcacagggaagctgggaggagtccgcctagatgggtaaggacggtatttttggcagcagttccggggaccctcccctgatcagcctgcacttccgccctgggttgaggggagcatttccagcgagggggcgaagaggagacgggatggaagagagagaagaggacgcccctgcttccaggggcaagtgggtacaaccagaggacgggacaatgttcccctggagaatggcccaggctccatctagacctggctggtcccagtcccaggcttgtcctaggtccttggcatccgtgctggtagcaaccccagggccaccctcagcgtctcatgacgtctacccttctctggcccctgtagaaattatgttcaagagaaaacacccggggggtcacaatgataacaataacaccaccacctgtgccccgtgggtgtgaggctgtcatgg
